US009006197B2

(12) United States Patent
Bumcrot et al.

(10) Patent No.: US 9,006,197 B2
(45) Date of Patent: Apr. 14, 2015

(54) COMPOSITIONS AND METHODS FOR INHIBITING EXPRESSION OF EG5 AND VEGF GENES

(75) Inventors: David Bumcrot, Belmont, MA (US);
Dinah Wen-Yee Sah, Boston, MA (US);
Ivanka Toudjarska, Medford, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 0 days.

(21) Appl. No.: 13/442,809

(22) Filed: Apr. 9, 2012

(65) Prior Publication Data

US 2013/0023577 A1  Jan. 24, 2013

Related U.S. Application Data

(63) Continuation of application No. 12/552,207, filed on Sep. 1, 2009, now abandoned, which is a continuation of application No. PCT/US2009/036223, filed on Mar. 5, 2009.

(60) Provisional application No. 61/150,664, filed on Feb. 6, 2009, provisional application No. 61/112,079, filed on Nov. 6, 2008, provisional application No. 61/086,381, filed on Aug. 5, 2008, provisional application No. 61/083,367, filed on Jul. 24, 2008, provisional application No. 61/034,019, filed on Mar. 5, 2008.

(51) Int. Cl.
*C12N 15/113* (2010.01)

(52) U.S. Cl.
CPC .......... *C12N 15/1136* (2013.01); *C12N 15/113* (2013.01); *C12N 2310/14* (2013.01); *C12N 2310/315* (2013.01); *C12N 2310/321* (2013.01); *C12N 2310/346* (2013.01); *C12N 2310/3515* (2013.01); *C12N 2320/31* (2013.01)

(58) Field of Classification Search
None
See application file for complete search history.

(56) References Cited

U.S. PATENT DOCUMENTS

| 7,427,605 | B2 | 9/2008 | Davis et al. |
|---|---|---|---|
| 7,718,629 | B2 | 5/2010 | Bumcrot et al. |
| 8,058,069 | B2 | 11/2011 | Yaworski et al. |
| 8,158,601 | B2 | 4/2012 | Chen et al. |
| 2003/0143732 | A1 | 7/2003 | Fosnaugh et al. |
| 2003/0170891 | A1 | 9/2003 | McSwiggen |
| 2004/0115201 | A1 | 6/2004 | Einat et al. |
| 2004/0209832 | A1 | 10/2004 | McSwiggen et al. |
| 2004/0259247 | A1 | 12/2004 | Tuschl et al. |
| 2005/0112141 | A1 | 5/2005 | Terman |
| 2006/0063751 | A1 | 3/2006 | Aquila et al. |
| 2006/0263435 | A1 | 11/2006 | Davis et al. |
| 2007/0004664 | A1 | 1/2007 | McSwiggen et al. |
| 2007/0031844 | A1 | 2/2007 | Khvorova et al. |
| 2007/0135372 | A1 | 6/2007 | MacLachlan et al. |
| 2007/0281899 | A1 | 12/2007 | Bumcrot et al. |
| 2008/0213350 | A1 | 9/2008 | Ko et al. |
| 2009/0099109 | A1 | 4/2009 | Shames et al. |
| 2009/0149403 | A1 | 6/2009 | MacLachlan |
| 2009/0291131 | A1 | 11/2009 | Maclachlan et al. |
| 2010/0267806 | A1 | 10/2010 | Bumcrot et al. |
| 2011/0015250 | A1 | 1/2011 | Bumcrot et al. |
| 2012/0244207 | A1 | 9/2012 | Fitzgerald et al. |

FOREIGN PATENT DOCUMENTS

| WO | WO 03/070918 A2 | 8/2003 |
|---|---|---|
| WO | WO 2004/065601 | 8/2004 |
| WO | WO 2004/080406 | 9/2004 |
| WO | WO 2004/090108 | 10/2004 |
| WO | WO 2005/014782 | 2/2005 |
| WO | WO 2005/089224 | 9/2005 |
| WO | WO 2007/012191 | 2/2007 |
| WO | WO 2007/115168 | 10/2007 |
| WO | WO 2010/147992 | 12/2010 |

OTHER PUBLICATIONS

Winstead, NCI Cancer Bulletin 2007, vol. 4, No. 19 [retrieved on Oct. 8, 2013]. Retrieved from the internet <URL: http://www.cancer.gov/ncicancerbulletin/archive/2007/061207/page2>.*
European Patent Office, Extended European Search Report, European Patent Application No. 12166396.7, Oct. 31, 2012, 8 Pages.
Harborth, J., et al., "Sequence, Chemical, and Structural Variation on Small Interfering RNAs and Short Hairpin RNAs and the Effect on Mammalian Gene Silencing," Antisense and Nucleic Acid Drug Development, vol. 13, pp. 83-105, 2003.
The State Intellectual Property Office of the People's Republic of China, Notification of the First Office Action, Chinese Patent Application No. 201080020483.1, Sep. 28, 2012, 14 Pages.
Agrawal, S., et al., "Antisense oligonucleotides: towards clinical trials." Trends in Biotechnology. Oct. 1996, vol. 14, pp. 376-387.
Bass, B., "The short answer," Nature, May 24, 2001, pp. 428-429, vol. 411.
Cui, W., et al., "OptiRNAi, an RNAi design tool," Computer Methods and Programs Biomedicine, 2004, vol. 75, p. 67-73.
Elbashir, S., et al., "Analysis of gene function in somatic mammalian cells using small interfering RNAs," Methods, 2002, pp. 199-213, vol. 26.
Elbashir, S., et al., "Duplexes of 21-nucleotide RNAs mediate RNA interference in mammalian cell culture," Nature, May 24, 2001, p. 494-498, vol. 411.
Elbashir, S., et al., "Functional Anatomy of siRNAs for Mediating Efficient RNAi in *Drosophila melanogaster* Embryo Lysate", The EMBO Journal, 2001, pp. 6877-6888, vol. 20, No. 23.

(Continued)

*Primary Examiner* — Tracy Vivlemore
(74) *Attorney, Agent, or Firm* — Fenwick & West LLP

(57) ABSTRACT

This invention relates to compositions containing double-stranded ribonucleic acid (dsRNA) in a SNALP formulation, and methods of using the compositions to inhibit the expression of the Eg5 and Vascular Endothelial Growth Factor (VEGF), and methods of using the compositions to treat pathological processes mediated by Eg5 and VEGF expression, such as cancer.

27 Claims, 24 Drawing Sheets

(56) References Cited

OTHER PUBLICATIONS

Elbashir, S., et al., "RNA Interference is Mediated by 21-and 22 Nucleotide RNAs," Genes & Development, 2001, pp. 188-200, vol. 15.
Examination Report for New Zealand Patent Application No. NZ 587704, Feb. 16, 2012, 2 Pages.
Fire, A., "RNA-triggered Gene Silencing," Trends in Genetics, Sep. 1999, pp. 358-363, vol. 15, No. 9.
Fire, A., et al., "Potent and Specific Genetic Interference by Double Stranded RNA in *Caenorhabditis elegans*," Nature, Feb. 19, 1998, pp. 806-811, vol. 391.
Haque, S., et al., "Monastrol, a Prototype Anti-Cancer Drug That Inhibits Mitotic Kinesin, Induces Rapid Bursts of Axonal Outgrowth From Cultured Postmitotic Neurons," Cell Motility and the Cytoskeleton, 2004, vol. 58, p. 10-16.
Japanese Patent Office, Notice of Reasons for Rejection, Japanese Patent Application No. 2009-503309, mailed Aug. 10, 2012, 10 pages.
Japanese Patent Office, Notice of Reasons for Rejection, Japanese Patent Application No. 2009-503309 mailed Mar. 28, 2012, 10 Pages.
Luo, L., et al., "Mechanism of Inhibition of Human KSP by Monastrol: Insights from Kinetic Analysis and the Effect of Ionic Strength on KSP Inhibition," Biochemistry, 2004, vol. 43, p. 15258-15266.
Office Action for U.S. Appl. No. 12/723,471, Jan. 19, 2012, 15 Pages.
Office Action for U.S. Appl. No. 12/723,471, May 22, 2012, 7 Pages.
Reynolds, et al. (2004) "Rational siRNA design for RNA interference," Nature Biotechnology, vol. 22, No. 3, pp. 326-330.
Robbins, M., et al., "Stable expression of shRNAs in human CD34[30] progenitor cells can avoid induction of interferon responses to siRNAs in vitro," Nature Biotechnology, May 2006, pp. 566-571, vol. 24, No. 5.
Rose, S., et al., "Functional polarity is introduced by Dicer processing of short substrate RNAs," Nucleic Acids Research, 2005, pp. 4140-4156, vol. 33, No. 13.
Sunder-Plassmann, N., et al., "Systhesis and biological evaluation of new tetrahydro-β-cardonlines as inhibitors of the mitotic kinesin Eg5," Bioorganic & Medicinal Chemistry, 2005, vol. 13, p. 6094-6111.
Takimoto, C., et al., "Safety and anti-tumor activity of sorafenib (Nexavar®) in combination with other anti-cancer agents: a review of clinical trials," Cancer Chemother. Pharmacol., 2008, vol. 61, pp. 535-548.
The State Intellectual Property Office of the People's Republic of China, Notification of the Third Office Action, Chinese Patent Application No. 200780018407.5, Aug. 31, 2012, 9 pages.
Tuschl T., "RNA Interference and Small Interfering RNAs" Chembiochem, 2001, pp. 239-245, vol. 2.
Tuschl, T., "Expanding small RNA interference," Nature Biotechnology, May 2002, pp. 446-448, vol. 20.
Tuschl, T., "Functional genomics: RNA sets the standard," Nature, Jan. 16, 2003, vol. 421, No. 6920, pp. 220-221.
Tuschl, T., "Mammalian RNA Interference," RNAi, A Guide to Gene Silencing, Chapter 13, G.J. Hannon (ed,), 2003, pp. 265-295.
Tuschl, T., et al., "Small Interfering RNAs: A Revolutionary Tool for the Analysis of Gene Function and Gene Therapy," Molecular Interventions, 2002, pp. 158-167, vol. 2, No. 3.
Tuschl, T., et al., "Targeted mRNA Degradation by Double-Stranded RNA In Vitro," Genes & Development, 1999, pp. 3191-3197, vol. 13.
Vickers, T., et al., "Efficient Reduction of Target RNAs by Small Interfering RNA and RNase H-dependent Antisense Agents," The Journal of Biological Chemistry, Feb. 28, 2003, pp. 7108-7118, vol. 278, No. 9.
Weil, et al (2002) "Targeting the Kinesin Eg5 to Monitor siRNA Transfection in Mammalian Cells," *Biotechniques* 33(6):1244-1248.
Zhu, A., "Development of Sorafenib and Other Molecularly Targeted Agents in Hepatocellular Carcinoma," Cancer, 2008, vol. 112, No. 2, pp. 250-259.
Zimmerman, et al. (2006) "RNAi-mediated gene silencing in non-human primates," *Nature*, vol. 441, May 4: 111-114.
Harborth, J., et al., "Identification of essential genes in cultured mammalian cells using small interfering RNAs," Journal of Cell Science, 2001, vol. 114, No. 24, pp. 4557-4565.
The State Intellectual Property Office of the People's Republic of China, Notification of Second Office Action, Chinese Patent Application No. 200980115656.5, Mar. 13, 2013, 13 pages.
Hornung, V., et al., "Sequence-specific potent induction of IFN-α by short interfering RNA in plasmacytoid dendritic cells through TLR7," Nature Medicine, Mar. 2005, pp. 263-270, vol. 11, No. 3.
NCBI, "*Homo sapiens* kinesin family member 11 (KIF11), mRNA," GenBank Accession No. NM_004523, Mar. 24, 2014, 6 Pages [online] [retrieved on Apr. 21, 204] Retrieved from the internet <URL:http://www.ncbi.nlm.nih.gov/nuccore/NM_004523>.
Office Action for U.S. Appl. No. 13/797,176 mailed on Mar. 21, 2014, 9 pages.
Office Action for U.S. Appl. No. 13/620,212 mailed on Feb. 6, 2014, 6 Pages.
Office Action for U.S. Appl. No. 12/723,471 mailed on Jan. 7, 2014, 7 pages.

\* cited by examiner

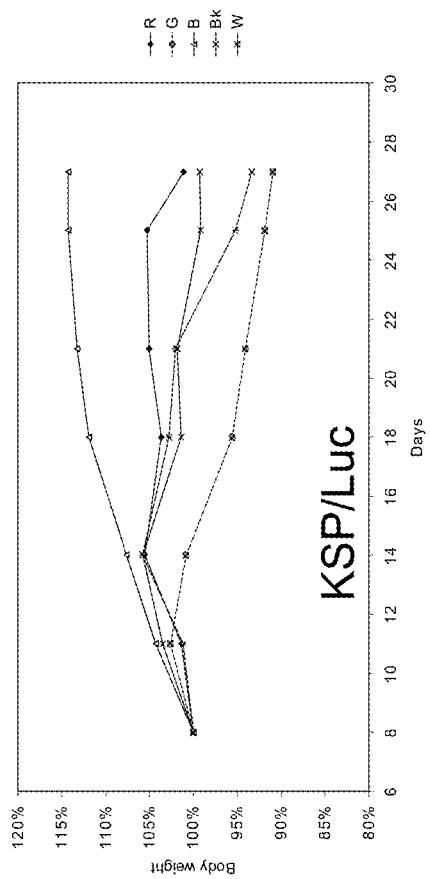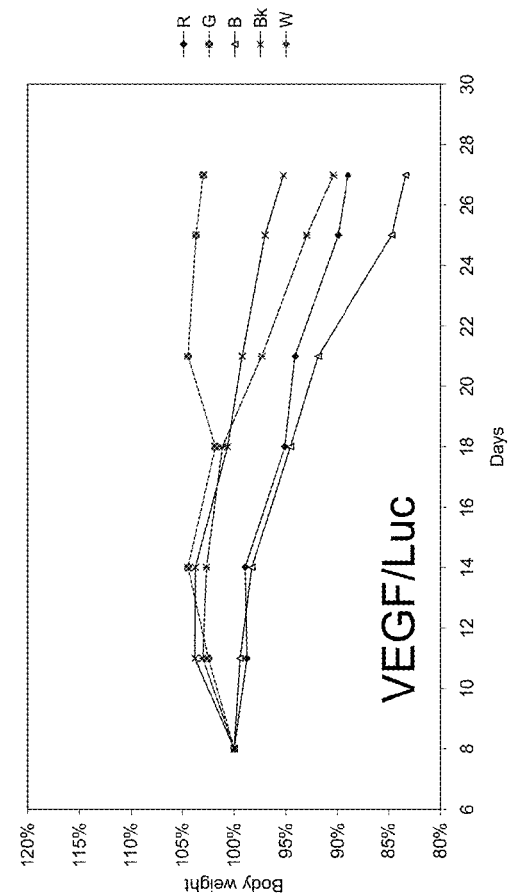
FIG. 2C
FIG. 2D

FIG. 11B
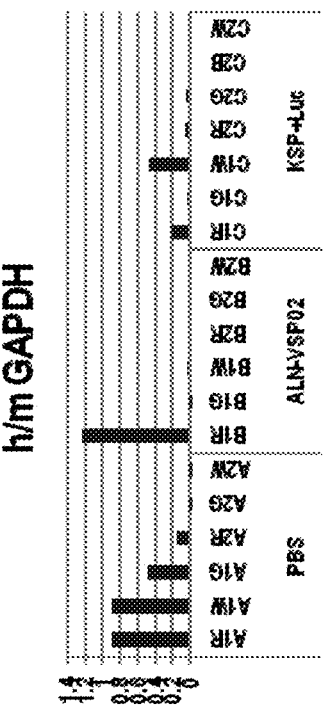
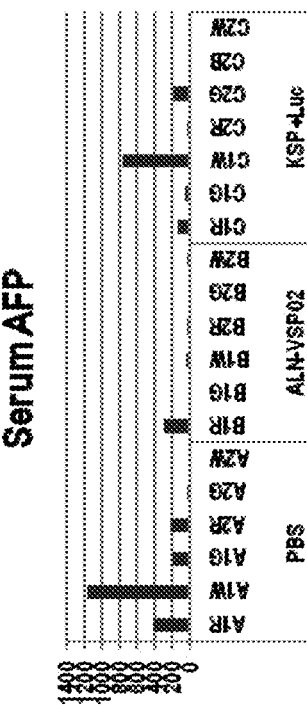
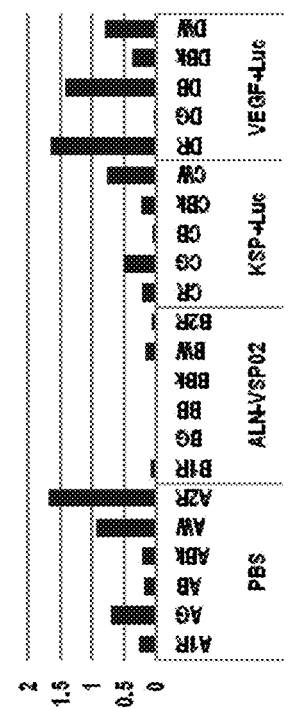
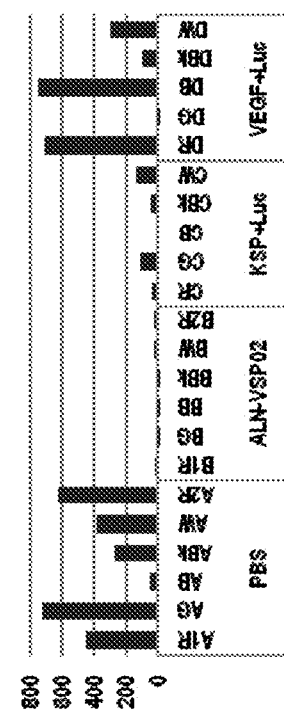

* 4 mg/kg dose
** 3 mg/kg dose

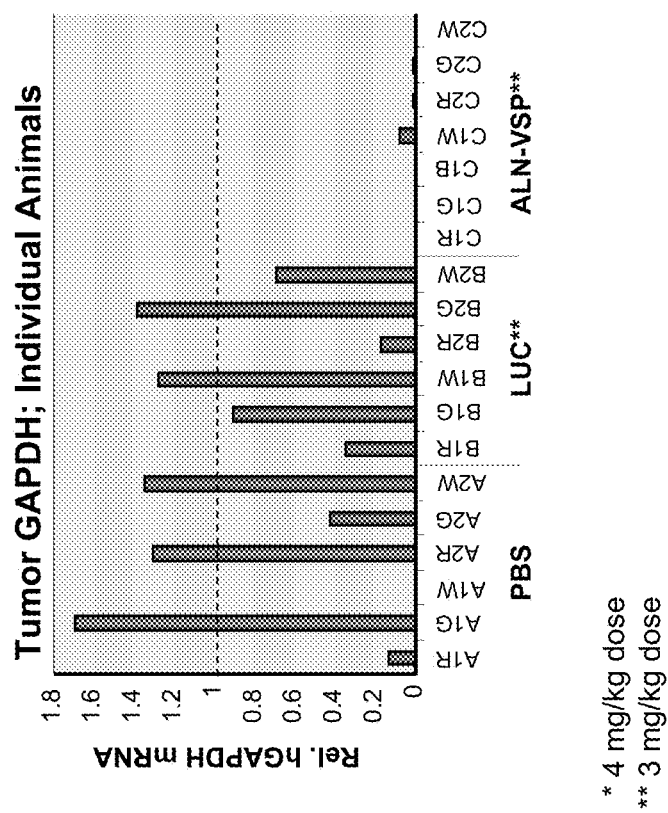

A. SNALP-VSP treated

B. SNALP-Luc treated

COMPOSITIONS AND METHODS FOR INHIBITING EXPRESSION OF EG5 AND VEGF GENES

RELATED APPLICATIONS

This application is a continuation of U.S. patent application Ser. No. 12/552,207, filed Sep. 1, 2009, which is a continuation of PCT Application No. PCT/US2009/036233, filed Mar. 5, 2009 which claims the benefit of U.S. Provisional Application No. 61/034,019, filed Mar. 5, 2008, and U.S. Provisional Application No. 61/083,367, filed Jul. 24, 2008, and U.S. Provisional Application No. 61/086,381, filed Aug. 5, 2008, and U.S. Provisional Application No. 61/112,079, filed Nov. 6, 2008, and U.S. Provisional Application No. 61/150,664, filed Feb. 6, 2009 which are hereby incorporated in their entirety by reference.

FIELD OF THE INVENTION

This invention relates to compositions containing double-stranded ribonucleic acid (dsRNA), and their use in mediating RNA interference to inhibit the expression of a combination of genes, e.g., the Eg5 and Vascular Endothelial Growth Factor (VEGF) genes formulated in SNALP, and the use of the compositions to treat pathological processes mediated by Eg5 and VEGF expression, such as cancer.

REFERENCE TO SEQUENCE LISTING

This application includes a Sequence Listing submitted electronically as a text file named 20876_sequence_listing.txt, created on Apr. 9, 2012, with a size of 640,482 bytes. The sequence listing is incorporated by reference.

BACKGROUND OF THE INVENTION

The maintenance of cell populations within an organism is governed by the cellular processes of cell division and programmed cell death. Within normal cells, the cellular events associated with the initiation and completion of each process is highly regulated. In proliferative disease such as cancer, one or both of these processes may be perturbed. For example, a cancer cell may have lost its regulation (checkpoint control) of the cell division cycle through either the overexpression of a positive regulator or the loss of a negative regulator, perhaps by mutation.

Alternatively, a cancer cell may have lost the ability to undergo programmed cell death through the overexpression of a negative regulator. Hence, there is a need to develop new chemotherapeutic drugs that will restore the processes of checkpoint control and programmed cell death to cancerous cells.

One approach to the treatment of human cancers is to target a protein that is essential for cell cycle progression. In order for the cell cycle to proceed from one phase to the next, certain prerequisite events must be completed. There are checkpoints within the cell cycle that enforce the proper order of events and phases. One such checkpoint is the spindle checkpoint that occurs during the metaphase stage of mitosis. Small molecules that target proteins with essential functions in mitosis may initiate the spindle checkpoint to arrest cells in mitosis. Of the small molecules that arrest cells in mitosis, those which display anti-tumor activity in the clinic also induce apoptosis, the morphological changes associated with programmed cell death. An effective chemotherapeutic for the treatment of cancer may thus be one which induces checkpoint control and programmed cell death. Unfortunately, there are few compounds available for controlling these processes within the cell. Most compounds known to cause mitotic arrest and apoptosis act as tubulin binding agents. These compounds alter the dynamic instability of microtubules and indirectly alter the function/structure of the mitotic spindle thereby causing mitotic arrest. Because most of these compounds specifically target the tubulin protein which is a component of all microtubules, they may also affect one or more of the numerous normal cellular processes in which microtubules have a role. Hence, there is also a need for agents that more specifically target proteins associated with proliferating cells.

Eg5 is one of several kinesin-like motor proteins that are localized to the mitotic spindle and known to be required for formation and/or function of the bipolar mitotic spindle. Recently, there was a report of a small molecule that disturbs bipolarity of the mitotic spindle (Mayer, T. U. et. al. 1999. Science 286(5441) 971-4, herein incorporated by reference). More specifically, the small molecule induced the formation of an aberrant mitotic spindle wherein a monoastral array of microtubules emanated from a central pair of centrosomes, with chromosomes attached to the distal ends of the microtubules. The small molecule was dubbed "monastrol" after the monoastral array. This monoastral array phenotype had been previously observed in mitotic cells that were immunodepleted of the Eg5 motor protein. This distinctive monoastral array phenotype facilitated identification of monastrol as a potential inhibitor of Eg5. Indeed, monastrol was further shown to inhibit the Eg5 motor-driven motility of microtubules in an in vitro assay. The Eg5 inhibitor monastrol had no apparent effect upon the related kinesin motor or upon the motor(s) responsible for golgi apparatus movement within the cell. Cells that display the monoastral array phenotype either through immunodepletion of Eg5 or monastrol inhibition of Eg5 arrest in M-phase of the cell cycle. However, the mitotic arrest induced by either immunodepletion or inhibition of Eg5 is transient (Kapoor, T. M., 2000. J Cell Biol 150(5) 975-80). Both the monoastral array phenotype and the cell cycle arrest in mitosis induced by monastrol are reversible. Cells recover to form a normal bipolar mitotic spindle, to complete mitosis and to proceed through the cell cycle and normal cell proliferation. These data suggest that an inhibitor of Eg5 which induced a transient mitotic arrest may not be effective for the treatment of cancer cell proliferation. Nonetheless, the discovery that monastrol causes mitotic arrest is intriguing and hence there is a need to further study and identify compounds which can be used to modulate the Eg5 motor protein in a manner that would be effective in the treatment of human cancers. There is also a need to explore the use of these compounds in combination with other antineoplastic agents.

VEGF (also known as vascular permeability factor, VPF) is a multifunctional cytokine that stimulates angiogenesis, epithelial cell proliferation, and endothelial cell survival. VEGF can be produced by a wide variety of tissues, and its overexpression or aberrant expression can result in a variety disorders, including cancers and retinal disorders such as age-related macular degeneration and other angiogenic disorders.

Recently, double-stranded RNA molecules (dsRNA) have been shown to block gene expression in a highly conserved regulatory mechanism known as RNA interference (RNAi). WO 99/32619 (Fire et al.) discloses the use of a dsRNA of at least 25 nucleotides in length to inhibit the expression of genes in *C. elegans*. dsRNA has also been shown to degrade target RNA in other organisms, including plants (see, e.g., WO 99/53050, Waterhouse et al.; and WO 99/61631, Heifetz et al.), *Drosophila* (see, e.g., Yang, D., et al., *Curr. Biol.* (2000) 10:1191-1200), and mammals (see WO 00/44895, Limmer; and DE 101 00 586.5, Kreutzer et al.). This natural mechanism has now become the focus for the development of a new class of pharmaceutical agents for treating disorders that are caused by the aberrant or unwanted regulation of a gene.

SUMMARY OF THE INVENTION

Disclosed are compositions having two double-stranded ribonucleic acids (dsRNA) for inhibiting the expression of a human kinesin family member 11 (Eg5/KSP) and a human VEGF gene in a cell. The dsRNAs are formulated in a stable nucleic acid lipid particle (SNALP). Also disclosed are method for using the composition to decrease expression of Eg5/KSP and/or VEGF in a cell, and method of treatment of a disease, e.g., liver cancer, using the compositions of the invention.

Accordingly, disclosed herein is a composition having a first double-stranded ribonucleic acid (dsRNA) for inhibiting the expression of a human kinesin family member 11 (Eg5/KSP) gene in a cell and a second dsRNA for inhibiting expression of a human VEGF in a cell, wherein both said first and said second dsRNA are formulated in a stable nucleic acid lipid particle (SNALP); said first dsRNA consists of a first sense strand and a first antisense strand, and said first sense strand has a first sequence and said first antisense strand has a second sequence complementary to at least 15 contiguous nucleotides of SEQ ID NO: 1311 (5'-UCGAGAAUC-UAAACUAACU-3'), wherein said first sequence is complementary to said second sequence and wherein said first dsRNA is between 15 and 30 base pairs in length; and said second dsRNA consists of a second sense strand and a second antisense strand, said second sense strand having a third sequence and said second antisense strand having a fourth sequence complementary to at least 15 contiguous nucleotides of SEQ ID NO: 1538 (5'-GCACAUAG-GAGAGAUGAGCUU-3'), wherein said third sequence is complementary to said fourth sequence and wherein each strand is between 15 and 30 base pairs in length.

In some embodiments, the first antisense strand has a second sequence complementary to SEQ ID NO: 1311 (5'-UC-GAGAAUCUAAACUAACU-3') and the second antisense strand has a fourth sequence complementary to SEQ ID NO: 1538 (5'-GCACAUAGGAGAGAUGAGCUU-3'). In other embodiments, the first dsRNA consists of a sense strand consisting of SEQ ID NO: 1534 (5'-UCGAGAAUCUAAAC-UAACUTT-3') and an antisense strand consisting of SEQ ID NO: 1535 (5'-AGUUAGUUUAGAUUCUCGATT-3') and the second dsRNA consists of a sense strand consisting of SEQ ID NO:1536 (5'-GCACAUAGGAGAGAUGAGCUU-3'), and an antisense strand consisting of SEQ ID NO: 1537 (5'-AAGCUCAUCUCUCCUAUGUGCUG-3'). In further embodiments, each strand is modified as follows to include a 2'-O-methyl ribonucleotide as indicated by a lower case letter "c" or "u" and a phosphorothioate as indicated by a lower case letter "s": the first dsRNA consists of a sense strand consisting of SEQ ID NO: 1240 (5'-ucGAGAAucuAAAcuAAcuTsT-3'), and an antisense strand consisting of SEQ ID NO: 1241 (5'-AGUuAGUUuAGAUUCUCGATsT); the second dsRNA consists of a sense strand consisting of SEQ ID NO: 1242 (5'-GcAcAuAGGAGAGAuGAGCUsU-3') and an antisense strand consisting of SEQ ID NO: 1243 (5'-AAGCUcAUCU-CUCCuAuGuGCusG-3').

In some embodiments, the first dsRNA contains two overhangs and the second dsRNA contains an overhang at the 3' of the antisense and a blunt end at the 5' end of the antisense strand.

The first and second dsRNA can have at least one modified nucleotide. For example, each dsRNA can have at least one modified nucleotide chosen from the group of: a 2'-O-methyl modified nucleotide, a nucleotide having a 5'-phosphorothioate group, and a terminal nucleotide linked to a cholesteryl derivative or dodecanoic acid bisdecylamide group. The modified nucleotide can be chosen from the group of: a 2'-deoxy-2'-fluoro modified nucleotide, a 2'-deoxy-modified nucleotide, a locked nucleotide, an abasic nucleotide, 2'-amino-modified nucleotide, 2'-alkyl-modified nucleotide, morpholino nucleotide, a phosphoramidate, and a non-natural base having nucleotide. In some embodiments, the first and second dsRNA each comprise at least one 2'-O-methyl modified ribonucleotide and at least one nucleotide having a 5'-phosphorothioate group.

Each strand of each dsRNA can be, e.g., 19-23 bases in length, or, alternatively 21-23 bases in length. In one embodiment, each strand of the first dsRNA is 21 bases in length and the sense strand of the second dsRNA is 21 bases in length and the antisense strand of the second dsRNA is 23 bases in length.

In some embodiments, the first and second dsRNA are present in an equimolar ratio.

As described herein, the dsRNAs are formulated as SNALPS. In some embodiments, the SNALP formulation includes DLinDMA, cholesterol, DPPC, and PEG2000-C-DMA. For example, the SNALP can have the components in the proportions listed in Table 17.

The composition of the invention can be used to reduce expression of Eg5 and/or VAGF. In some embodiments, the composition of the invention, upon contact with a cell expressing Eg5, inhibits expression of Eg5 by at least 40, 50, 60, 70, 80, or by at least 90%. In other embodiments, the composition of the invention, upon contact with a cell expressing VEGF, inhibits expression of VEGF by at least 40, 50, 60, 70, 80, or by at least 90%. Administration of the composition to a cell can expression of both Eg5 and VEGF in said cell. The composition of claims 1-17, wherein the composition is administered in a nM concentration.

Administration of the composition of the invention to a cell can result in, e.g., an increase in mono-aster formation in the cell. Administration of the composition to a mammal can result in at least one effect selected from the group consisting of prevention of tumor growth, reduction in tumor growth, or prolonged survival in said mammal. The effect can be measured using at least one assay selected from the group consisting of determination of body weight, determination of organ weight, visual inspection, mRNA analysis, serum AFP analysis and survival monitoring. Included are compositions with these effect when administered in a nM concentration.

In a further embodiment the composition of the invention includes Sorafenib.

Also included in the invention are methods of suing the compositions of the invention. In one embodiment is are methods for inhibiting the expression of Eg5/KSP and VEGF in a cell by administering any of the compositions of the invention to the cell. Other embodiments are methods for preventing tumor growth, reducing tumor growth, or prolonging survival in a mammal in need of treatment for cancer by administering the composition to said mammal. In some embodiments the mammal has liver cancer, e.g., the mammal is a human with liver cancer. The method can include a further step of administering Sorafenib.

BRIEF DESCRIPTION OF THE FIGURES

FIGS. 2A-2D are graphs showing the effects of SNALP-siRNAs on body weight in a Hep3B mouse model.

FIG. 11B is a set of graphs showing the effects of SNALP-siRNAs on human GAPDH levels and serum AFP levels in a Hep3B mouse model.

FIGS. 12A-12C are graphs showing the effects of SNALP-siRNAs on tumor KSP, VEGF and GAPDH levels in a Hep3B mouse model.

DETAILED DESCRIPTION OF THE INVENTION

Figure 1:
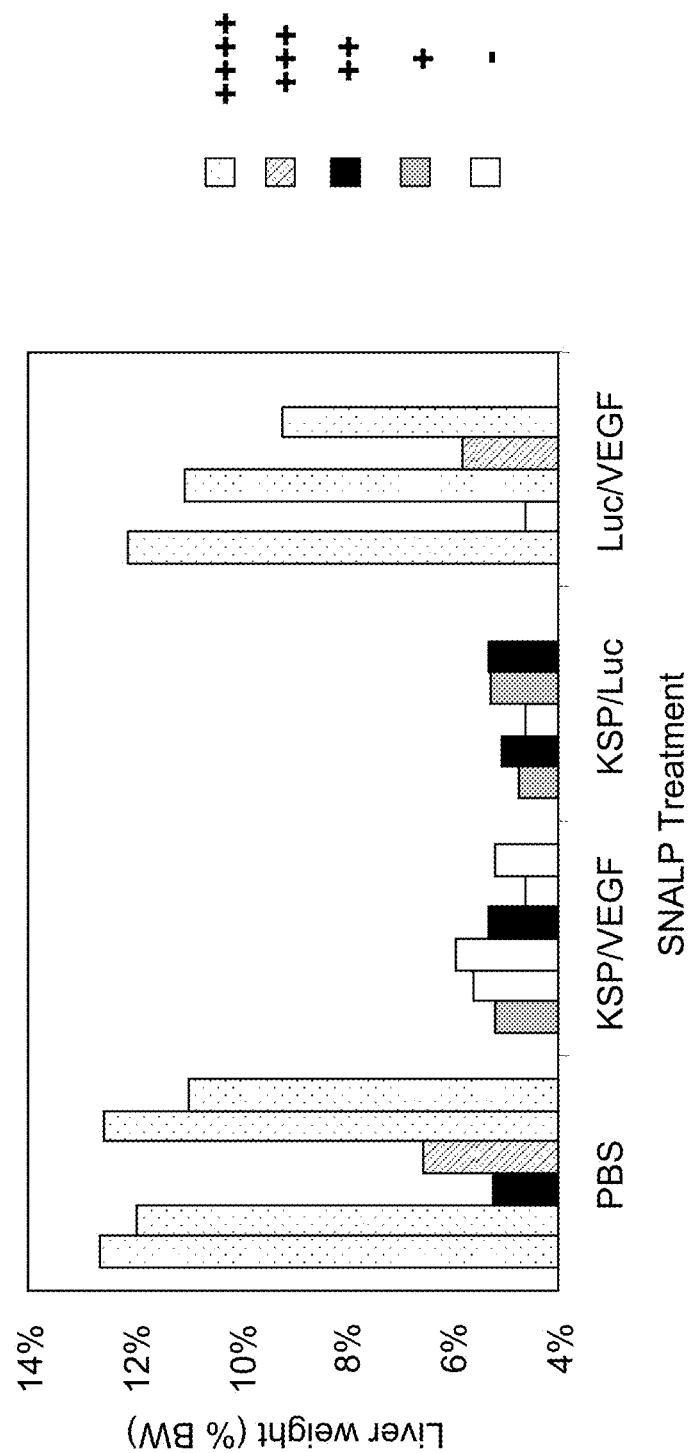
FIG. 1 is a graph showing liver weights as percentage of body weight following administration of SNALP-siRNAs in a Hep3B mouse model.
Figure 2B:
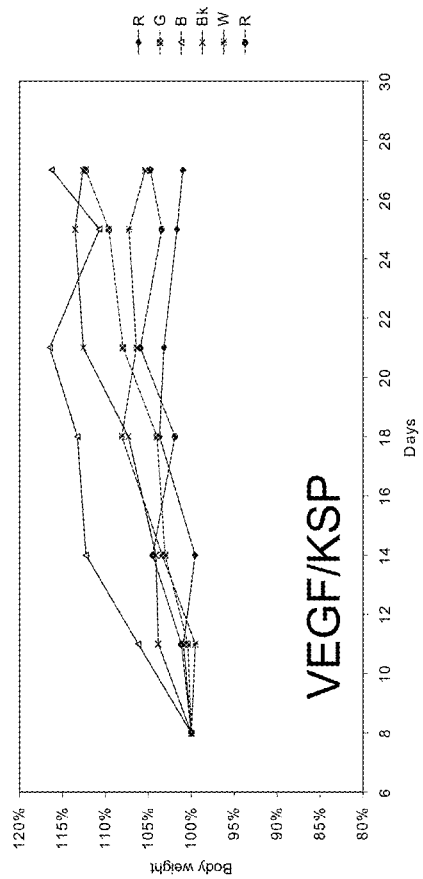
Figure 2A:
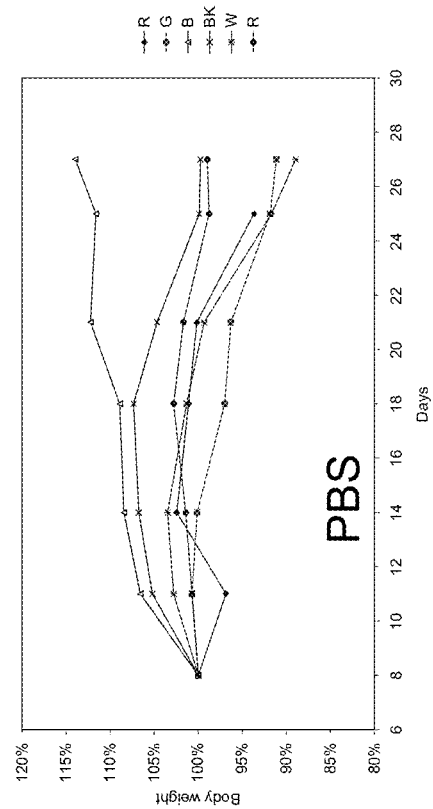

The invention provides compositions and methods for inhibiting the expression of the Eg5 gene and VEGF gene in a cell or mammal using the dsRNAs. The dsRNAs are preferably packaged in a stable nucleic acid particle (SNALP). The invention also provides compositions and methods for treating pathological conditions and diseases, such as liver cancer, in a mammal caused by the expression of the Eg5 gene and VEGF genes. The dsRNA directs the sequence-specific degradation of mRNA through a process known as RNA interference (RNAi).

The following detailed description discloses how to make and use the compositions containing dsRNAs to inhibit the expression of the Eg5 gene and VEGF genes, respectively, as well as compositions and methods for treating diseases and disorders caused by the expression of these genes, such as cancer. The pharmaceutical compositions featured in the invention include a dsRNA having an antisense strand comprising a region of complementarity which is less than 30 nucleotides in length, generally 19-24 nucleotides in length, and is substantially complementary to at least part of an RNA transcript of the Eg5 gene, together with a pharmaceutically acceptable carrier. The compositions featured in the invention also include a dsRNA having an antisense strand having a region of complementarity which is less than 30 nucleotides in length, generally 19-24 nucleotides in length, and is substantially complementary to at least part of an RNA transcript of the VEGF gene.

Accordingly, certain aspects of the invention provide pharmaceutical compositions containing the Eg5 and VEGF dsRNAs and a pharmaceutically acceptable carrier, methods of using the compositions to inhibit expression of the Eg5 gene and the VEGF gene respectively, and methods of using the pharmaceutical compositions to treat diseases caused by expression of the Eg5 and VEGF genes.

I. DEFINITIONS

For convenience, the meaning of certain terms and phrases used in the specification, examples, and appended claims, are provided below. If there is an apparent discrepancy between the usage of a term in other parts of this specification and its definition provided in this section, the definition in this section shall prevail.

"G," "C," "A" and "U" each generally stand for a nucleotide that contains guanine, cytosine, adenine, and uracil as a base, respectively. "T" and "dT" are used interchangeably herein and refer to a deoxyribonucleotide wherein the nucleobase is thymine, e.g., deoxyribothymine. However, it will be understood that the term "ribonucleotide" or "nucleotide" can also refer to a modified nucleotide, as further detailed below, or a surrogate replacement moiety. The skilled person is well aware that guanine, cytosine, adenine, and uracil may be replaced by other moieties without substantially altering the base pairing properties of an oligonucleotide comprising a nucleotide bearing such replacement moiety. For example, without limitation, a nucleotide comprising inosine as its base may base pair with nucleotides containing adenine, cytosine, or uracil. Hence, nucleotides containing uracil, guanine, or adenine may be replaced in the nucleotide sequences of the invention by a nucleotide containing, for example, inosine. In another example, adenine and cytosine anywhere in the oligonucleotide can be replaced with guanine and uracil, respectively to form G-U Wobble base pairing with the target mRNA. Sequences comprising such replacement moieties are embodiments of the invention.

As used herein, "Eg5" refers to the human kinesin family member 11, which is also known as KIF11, Eg5, HKSP, KSP, KNSL1 or TRIP5. Eg5 sequence can be found as NCBI GeneID:3832, HGNC ID: HGNC:6388 and RefSeq ID number:NM_004523. The terms "Eg5" and "KSP" and "Eg5/KSP are used interchangeably As used herein, VEGF, also known as vascular permeability factor, is an angiogenic growth factor. VEGF is a homodimeric 45 kDa glycoprotein that exists in at least three different isoforms. VEGF isoforms are expressed in endothelial cells. The VEGF gene contains 8 exons that express a 189-amino acid protein isoform. A 165-amino acid isoform lacks the residues encoded by exon 6, whereas a 121-amino acid isoform lacks the residues encoded by exons 6 and 7. VEGF145 is an isoform predicted to contain 145 amino acids and to lack exon 7. VEGF can act on endothelial cells by binding to an endothelial tyrosine kinase receptor, such as Flt-1 (VEGFR-1) or KDR/flk-1 (VEGFR-2). VEGFR-2 is expressed in endothelial cells and is involved in endothelial cell differentiation and vasculogenesis. A third receptor, VEGFR-3, has been implicated in lymphogenesis.

The various isoforms have different biologic activities and clinical implications. For example, VEGF145 induces angiogenesis and like VEGF189 (but unlike VEGF165) VEGF 145 binds efficiently to the extracellular matrix by a mechanism that is not dependent on extracellular matrix-associated heparin sulfates. VEGF displays activity as an endothelial cell mitogen and chemoattractant in vitro and induces vascular permeability and angiogenesis in vivo. VEGF is secreted by a wide variety of cancer cell types and promotes the growth of tumors by inducing the development of tumor-associated vasculature. Inhibition of VEGF function has been shown to limit both the growth of primary experimental tumors as well as the incidence of metastases in immunocompromised mice. Various dsRNAs directed to VEGF are described in co-pending U.S. Ser. Nos. 11/078,073 and 11/340,080, which are hereby incorporated by reference in their entirety.

As used herein, "target sequence" refers to a contiguous portion of the nucleotide sequence of an mRNA molecule formed during the transcription of the Eg5/KSP and/or VEGF gene, including mRNA that is a product of RNA processing of a primary transcription product.

As used herein, the term "strand comprising a sequence" refers to an oligonucleotide comprising a chain of nucleotides that is described by the sequence referred to using the standard nucleotide nomenclature.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions may include: 400 mM NaCl, 40 mM PIPES pH 6.4, 1 mM EDTA, 50° C. or 70° C. for 12-16 hours followed by washing. Other conditions, such as physiologically relevant conditions as may be encountered inside an organism, can apply. The skilled person will be able to determine the set of conditions most appropriate for a test of complementarity of two sequences in accordance with the ultimate application of the hybridized nucleotides.

This includes base-pairing of the oligonucleotide or polynucleotide comprising the first nucleotide sequence to the oligonucleotide or polynucleotide comprising the second nucleotide sequence over the entire length of the first and second nucleotide sequence. Such sequences can be referred to as "fully complementary" with respect to each other herein. However, where a first sequence is referred to as "substantially complementary" with respect to a second sequence herein, the two sequences can be fully complementary, or they may form one or more, but generally not more than 4, 3 or 2 mismatched base pairs upon hybridization, while retaining the ability to hybridize under the conditions most relevant to their ultimate application. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, may yet be referred to as "fully complementary" for the purposes of the invention.

"Complementary" sequences, as used herein, may also include, or be formed entirely from, non-Watson-Crick base pairs and/or base pairs formed from non-natural and modified nucleotides, in as far as the above requirements with respect to their ability to hybridize are fulfilled. Such non-Watson-Crick base pairs includes, but not limited to, G:U Wobble or Hoogstein base pairing.

The terms "complementary", "fully complementary" and "substantially complementary" herein may be used with respect to the base matching between the sense strand and the antisense strand of a dsRNA, or between the antisense strand of a dsRNA and a target sequence, as will be understood from the context of their use.

As used herein, a polynucleotide which is "substantially complementary to at least part of" a messenger RNA (mRNA) refers to a polynucleotide which is substantially complementary to a contiguous portion of the mRNA of interest (e.g., encoding Eg5/KSP and/or VEGF) including a 5' UTR, an open reading frame (ORF), or a 3' UTR. For example, a polynucleotide is complementary to at least a part of a Eg5 mRNA if the sequence is substantially complementary to a non-interrupted portion of a mRNA encoding Eg5.

The term "double-stranded RNA" or "dsRNA", as used herein, refers to a duplex structure comprising two anti-parallel and substantially complementary, as defined above, nucleic acid strands. The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5' end of the respective other strand forming the duplex structure, the connecting RNA chain is referred to as a "hairpin loop". Where the two strands are connected covalently by means other than an uninterrupted chain of nucleotides between the 3'-end of one strand and the 5' end of the respective other strand forming the duplex structure, the connecting structure is referred to as a "linker". The RNA strands may have the same or a different number of nucleotides. The maximum number of base pairs is the number of nucleotides in the shortest strand of the dsRNA minus any overhangs that are present in the duplex. In addition to the duplex structure, a dsRNA may comprise one or more nucleotide overhangs. In general, the majority of nucleotides of each strand are ribonucleotides, but as described in detail herein, each or both strands can also include at least one non-ribonucleotide, e.g., a deoxyribonucleotide and/or a modified nucleotide. In addition, as used in this specification, "dsRNA" may include chemical modifications to ribonucleotides, including substantial modifications at multiple nucleotides and including all types of modifications disclosed herein or known in the art. Any such modifications, as used in an siRNA type molecule, are encompassed by "dsRNA" for the purposes of this specification and claims.

As used herein, a "nucleotide overhang" refers to the unpaired nucleotide or nucleotides that protrude from the duplex structure of a dsRNA when a 3'-end of one strand of the dsRNA extends beyond the 5'-end of the other strand, or vice versa. "Blunt" or "blunt end" means that there are no unpaired nucleotides at that end of the dsRNA, i.e., no nucleotide overhang. A "blunt ended" dsRNA is a dsRNA that is double-stranded over its entire length, i.e., no nucleotide overhang at either end of the molecule. In some embodiments the dsRNA can have a nucleotide overhang at one end of the duplex and a blunt end at the other end.

The term "antisense strand" refers to the strand of a dsRNA which includes a region that is substantially complementary to a target sequence. As used herein, the term "region of complementarity" refers to the region on the antisense strand that is substantially complementary to a sequence, for example a target sequence, as defined herein. Where the region of complementarity is not fully complementary to the target sequence, the mismatches may be in the internal or terminal regions of the molecule. Generally the most tolerated mismatches are in the terminal regions, e.g., within 6, 5, 4, 3, or 2 nucleotides of the 5' and/or 3' terminus.

The term "sense strand," as used herein, refers to the strand of a dsRNA that includes a region that is substantially complementary to a region of the antisense strand.

As used herein, the term "SNALP" refers to a stable nucleic acid-lipid particle. A SNALP represents a vesicle of lipids coating a reduced aqueous interior comprising a nucleic acid such as an iRNA agent or a plasmid from which an iRNA agent is transcribed.

"Introducing into a cell", when referring to a dsRNA, means facilitating uptake or absorption into the cell, as is understood by those skilled in the art. Absorption or uptake of dsRNA can occur through unaided diffusive or active cellular processes, or by auxiliary agents or devices. The meaning of this term is not limited to cells in vitro; a dsRNA may also be "introduced into a cell", wherein the cell is part of a living organism. In such instance, introduction into the cell will include the delivery to the organism. For example, for in vivo delivery, dsRNA can be injected into a tissue site or administered systemically. In vitro introduction into a cell includes methods known in the art such as electroporation and lipofection.

The terms "silence" and "inhibit the expression of" "down-regulate the expression of," "suppress the expression of" and the like in as far as they refer to the Eg5 and/or VEGF gene, herein refer to the at least partial suppression of the expression of the Eg5 gene, as manifested by a reduction of the amount of Eg5 mRNA and/or VEGF mRNA which may be isolated from a first cell or group of cells in which the Eg5 and/or VEGF gene is transcribed and which has or have been treated such that the expression of the Eg5 and/or VEGF gene is inhibited, as compared to a second cell or group of cells substantially identical to the first cell or group of cells but which has or have not been so treated (control cells). The degree of inhibition is usually expressed in terms of $$\frac{(mRNA \text{ in control cells}) - (mRNA \text{ in treated cells})}{(mRNA \text{ in control cells})} \cdot 100\%$$

Alternatively, the degree of inhibition may be given in terms of a reduction of a parameter that is functionally linked to Eg5 and/or VEGF gene expression, e.g. the amount of protein encoded by the Eg5 and/or VEGF gene which is produced by a cell, or the number of cells displaying a certain phenotype, e.g. apoptosis. In principle, target gene silencing can be determined in any cell expressing the target, either constitutively or by genomic engineering, and by any appropriate assay. However, when a reference is needed in order to determine whether a given dsRNA inhibits the expression of the Eg5 gene by a certain degree and therefore is encompassed by the instant invention, the assay provided in the Examples below shall serve as such reference.

For example, in certain instances, expression of the Eg5 gene (or VEGF gene) is suppressed by at least about 5%, 10%, 15%, 20%, 25%, 30%, 35%, 40%, 45%, or 50% by administration of the double-stranded oligonucleotide of the invention. In some embodiments, the Eg5 and/or VEGF gene is suppressed by at least about 60%, 70%, or 80% by administration of the double-stranded oligonucleotide of the invention. In other embodiments, the Eg5 and/or VEGF gene is suppressed by at least about 85%, 90%, or 95% by administration of the double-stranded oligonucleotide of the invention. The Tables and Example below provides values for inhibition of expression using various Eg5 and/or VEGF dsRNA molecules at various concentrations.

As used herein in the context of Eg5 expression (or VEGF expression), the terms "treat", "treatment", and the like, refer to relief from or alleviation of pathological processes mediated by Eg5 and/or VEGF expression. In the context of the present invention insofar as it relates to any of the other conditions recited herein below (other than pathological processes mediated by Eg5 and/or VEGF expression), the terms "treat", "treatment", and the like mean to relieve or alleviate at least one symptom associated with such condition, or to slow or reverse the progression of such condition, such as the slowing and progression of hepatic carcinoma.

As used herein, the phrases "therapeutically effective amount" and "prophylactically effective amount" refer to an amount that provides a therapeutic benefit in the treatment, prevention, or management of pathological processes mediated by Eg5 and/or VEGF expression or an overt symptom of pathological processes mediated by Eg5 and/or VEGF expression. The specific amount that is therapeutically effective can be readily determined by ordinary medical practitioner, and may vary depending on factors known in the art, such as, e.g. the type of pathological processes mediated by Eg5 and/or VEGF expression, the patient's history and age, the stage of pathological processes mediated by Eg5 and/or VEGF expression, and the administration of other anti-pathological processes mediated by Eg5 and/or VEGF expression agents.

As used herein, a "pharmaceutical composition" comprises a pharmacologically effective amount of a dsRNA and a pharmaceutically acceptable carrier. As used herein, "pharmacologically effective amount," "therapeutically effective amount" or simply "effective amount" refers to that amount of an RNA effective to produce the intended pharmacological, therapeutic or preventive result. For example, if a given clinical treatment is considered effective when there is at least a 25% reduction in a measurable parameter associated with a disease or disorder, a therapeutically effective amount of a drug for the treatment of that disease or disorder is the amount necessary to effect at least a 25% reduction in that parameter.

The term "pharmaceutically acceptable carrier" refers to a carrier for administration of a therapeutic agent. As described in more detail below, such carriers include, but are not limited to, saline, buffered saline, dextrose, water, glycerol, ethanol, and combinations thereof. The term specifically excludes cell culture medium. For drugs administered orally, pharmaceutically acceptable carriers include, but are not limited to pharmaceutically acceptable excipients such as inert diluents, disintegrating agents, binding agents, lubricating agents, sweetening agents, flavoring agents, coloring agents and preservatives. Suitable inert diluents include sodium and calcium carbonate, sodium and calcium phosphate, and lactose, while corn starch and alginic acid are suitable disintegrating agents. Binding agents may include starch and gelatin, while the lubricating agent, if present, will generally be magnesium stearate, stearic acid or talc. If desired, the tablets may be coated with a material such as glyceryl monostearate or glyceryl distearate, to delay absorption in the gastrointestinal tract.

As used herein, a "transformed cell" is a cell into which a vector has been introduced from which a dsRNA molecule may be expressed.

II. DOUBLE-STRANDED RIBONUCLEIC ACID (DSRNA)

As described in more detail below, the invention provides double-stranded ribonucleic acid (dsRNA) molecules for inhibiting the expression of the Eg5 and/or VEGF gene in a cell or mammal, wherein the dsRNA comprises an antisense strand comprising a region of complementarity which is complementary to at least a part of an mRNA formed in the expression of the Eg5 and/or VEGF gene, and wherein the region of complementarity is less than 30 nucleotides in length, generally 19-24 nucleotides in length, and wherein said dsRNA, upon contact with a cell expressing said Eg5 and/or VEGF gene, inhibits the expression of said Eg5 and/or VEGF gene.

The dsRNA can be synthesized by standard methods known in the art as further discussed below, e.g., by use of an automated DNA synthesizer, such as are commercially available from, for example, Biosearch, Applied Biosystems, Inc.

The dsRNA comprises two strands that are sufficiently complementary to hybridize to form a duplex structure. One strand of the dsRNA (the antisense strand) comprises a region of complementarity that is substantially complementary, and generally fully complementary, to a target sequence, derived from the sequence of an mRNA formed during the expression of the Eg5 and/or VEGF gene, the other strand (the sense strand) comprises a region which is complementary to the antisense strand, such that the two strands hybridize and form a duplex structure when combined under suitable conditions. Generally, the duplex structure is between 15 and 30, more generally between 18 and 25, yet more generally between 19 and 24, and most generally between 19 and 21 base pairs in length. In other embodiments the duplex structure is 25-30 base pairs in length.

In one embodiment the duplex is 19 base pairs in length. In another embodiment the duplex is 21 base pairs in length. When two different siRNAs are used in combination, the duplex lengths can be identical or can differ. For example, a composition can include a first dsRNA targeted to Eg5 with a duplex length of 19 base pairs and a second dsRNA targeted to VEGF with a duplex length of 21 base pairs.

Similarly, the region of complementarity to the target sequence is between 15 and 30, more generally between 18 and 25, yet more generally between 19 and 24, and most generally between 19 and 21 nucleotides in length. In other embodiments the region of complementarity is 25-30 nucleotides in length.

In one embodiment the region of complementarity is 19 nucleotides in length. In another embodiment the region of complementarity is 21 nucleotides in length. When two different siRNAs are used in combination, the region of complementarity can be identical or can differ. For example, a composition can include a first dsRNA targeted to Eg5 with a region of complementarity of 19 nucleotides and a second dsRNA targeted to VEGF with a region of complementarity of 21 nucleotides.

Each strand of the dsRNA of invention is generally between 15 and 30, or between 18 and 25, or 18, 19, 20, 21, 22, 23, or 24 nucleotides in length. In other embodiments, each is strand is 25-30 base pairs in length. Each strand of the duplex can be the same length or of different lengths. When two different siRNAs are used in combination, the lengths of each strand of each siRNA can be identical or can differ. For example, a composition can include a dsRNA targeted to Eg5 with a sense strand of 21 nucleotides and an antisense strand of 21 nucleotides, and a second dsRNA targeted to VEGF with a sense strand of 21 nucleotides and an antisense strand of 23 nucleotides.

The dsRNA of the invention can include one or more single-stranded overhang(s) of one or more nucleotides. In one embodiment, at least one end of the dsRNA has a single-stranded nucleotide overhang of 1 to 4, generally 1 or 2 nucleotides. In another embodiment, the antisense strand of the dsRNA has 1-10 nucleotides overhangs each at the 3' end and the 5' end over the sense strand. In further embodiments, the sense strand of the dsRNA has 1-nucleotides overhangs each at the 3' end and the 5' end over the antisense strand.

A dsRNAs having at least one nucleotide overhang can have unexpectedly superior inhibitory properties than the blunt-ended counterpart. In some embodiments the presence of only one nucleotide overhang strengthens the interference activity of the dsRNA, without affecting its overall stability. A dsRNA having only one overhang has proven particularly stable and effective in vivo, as well as in a variety of cells, cell culture mediums, blood, and serum. Generally, the single-stranded overhang is located at the 3'-terminal end of the antisense strand or, alternatively, at the 3'-terminal end of the sense strand. The dsRNA can also have a blunt end, generally located at the 5'-end of the antisense strand. Such dsRNAs can have improved stability and inhibitory activity, thus allowing administration at low dosages, i.e., less than 5 mg/kg body weight of the recipient per day. Generally, the antisense strand of the dsRNA has a nucleotide overhang at the 3'-end, and the 5'-end is blunt. In another embodiment, one or more of the nucleotides in the overhang is replaced with a nucleoside thiophosphate.

As described in more detail herein, the composition of the invention includes a first dsRNA targeting Eg5 and a second dsRNA targeting VEGF. The first and second dsRNA can have the same overhang architecture, e.g., number of nucleotide overhangs on each strand, or each dsRNA can have a different architecture. In one embodiment, the first dsRNA targeting Eg5 includes a 2 nucleotide overhang at the 3' end of each strand and the second dsRNA targeting VEGF includes a 2 nucleotide overhang on the 3' end of the antisense strand and a blunt end at the 5' end of the antisense strand (e.g., the 3' end of the sense strand).

In one embodiment, the Eg5 gene targeted by the dsRNA of the invention is the human Eg5 gene. In one embodiment, the antisense strand of the dsRNA targeting Eg5 comprises at least 15 contiguous nucleotides of one of the antisense sequences of Table 1-3. In specific embodiments, the first sequence of the dsRNA is selected from one of the sense strands of Tables 1-3 and the second sequence is selected from the group consisting of the antisense sequences of Tables 1-3. Alternative antisense agents that target elsewhere in the target sequence provided in Tables 1-3 can readily be determined using the target sequence and the flanking Eg5 sequence. In some embodiments the dsRNA targeted to Eg5 will comprise at least two nucleotide sequence selected from the groups of sequences provided in Tables 1-3. One of the two sequences is complementary to the other of the two sequences, with one of the sequences being substantially complementary to a sequence of an mRNA generated in the expression of the Eg5 gene. As such, the dsRNA will comprises two oligonucleotides, wherein one oligonucleotide is described as the sense strand in Tables 1-3 and the second oligonucleotide is described as the antisense strand in Tables 1-3

In embodiments using a second dsRNA targeting VEGF, such agents are exemplified in the Examples, Tables 4a and 4b, and in co-pending U.S. Ser. Nos. 11/078,073 and 11/340,080, herein incorporated by reference. In one embodiment the dsRNA targeting VEGF has an antisense strand complementary to at least 15 contiguous nucleotides of the VEGF target sequences described in Table 4a. In other embodiments, the dsRNA targeting VEGF comprises one of the antisense sequences of Table 4b, or one of the sense sequences of Table 4b, or comprises one of the duplexes (sense and antisense strands) of Table 4b.

The skilled person is well aware that dsRNAs comprising a duplex structure of between 20 and 23, but specifically 21, base pairs have been hailed as particularly effective in inducing RNA interference (Elbashir et al., EMBO 2001, 20:6877-6888). However, others have found that shorter or longer dsRNAs can be effective as well. In the embodiments described above, by virtue of the nature of the oligonucleotide sequences provided in Tables 1-3, the dsRNAs of the invention can comprise at least one strand of a length of minimally 21 nt. It can be reasonably expected that shorter dsRNAs comprising one of the sequences of Tables 1-3 minus only a few nucleotides on one or both ends may be similarly effective as compared to the dsRNAs described above. Hence, dsRNAs comprising a partial sequence of at least 15, 16, 17, 18, 19, 20, or more contiguous nucleotides from one of the sequences of Tables 1-3, and differing in their ability to inhibit the expression of the Eg5 gene in a FACS assay as described herein below by not more than 5, 10, 15, 20, 25, or 30% inhibition from a dsRNA comprising the full sequence, are contemplated by the invention. Further dsRNAs that cleave within the target sequence provided in Tables 1-3 can readily be made using the Eg5 sequence and the target sequence provided. Additional dsRNA targeting VEGF can be designed in a similar matter using the sequences disclosed in Tables 4a and 4b, the Examples and co-pending U.S. Ser. Nos. 11/078,073 and 11/340,080, herein incorporated by reference.

In addition, the RNAi agents provided in Tables 1-3 identify a site in the Eg5 mRNA that is susceptible to RNAi based cleavage. As such the present invention further includes RNAi agents, e.g., dsRNA, that target within the sequence targeted by one of the agents of the present invention. As used herein a second RNAi agent is said to target within the sequence of a first RNAi agent if the second RNAi agent cleaves the message anywhere within the mRNA that is complementary to the antisense strand of the first RNAi agent. Such a second agent will generally consist of at least 15 contiguous nucleotides from one of the sequences provided in Tables 1-3 coupled to additional nucleotide sequences taken from the region contiguous to the selected sequence in the Eg5 gene. For example, the last 15 nucleotides of SEQ ID NO: 1 combined with the next 6 nucleotides from the target Eg5 gene produces a single strand agent of 21 nucleotides that is based on one of the sequences provided in Tables 1-3. Additional RNAi agents, e.g., dsRNA, targeting VEGF can be designed in a similar matter using the sequences disclosed in Tables 4a and 4b, the Examples and co-pending U.S. Ser. Nos. 11/078,073 and 11/340,080, herein incorporated by reference.

The dsRNA of the invention can contain one or more mismatches to the target sequence. In a preferred embodiment, the dsRNA of the invention contains no more than 3 mismatches. If the antisense strand of the dsRNA contains mismatches to a target sequence, it is preferable that the area of mismatch not be located in the center of the region of complementarity. If the antisense strand of the dsRNA contains mismatches to the target sequence, it is preferable that the mismatch be restricted to 5 nucleotides from either end, for example 5, 4, 3, 2, or 1 nucleotide from either the 5' or 3' end of the region of complementarity. For example, for a 23 nucleotide dsRNA strand which is complementary to a region of the Eg5 gene, the dsRNA generally does not contain any mismatch within the central 13 nucleotides. The methods described within the invention can be used to determine whether a dsRNA containing a mismatch to a target sequence is effective in inhibiting the expression of the Eg5 gene. Consideration of the efficacy of dsRNAs with mismatches in inhibiting expression of the Eg5 gene is important, especially if the particular region of complementarity in the Eg5 gene is known to have polymorphic sequence variation within the population.

Modifications

In yet another embodiment, the dsRNA is chemically modified to enhance stability. The nucleic acids of the invention may be synthesized and/or modified by methods well established in the art, such as those described in "Current protocols in nucleic acid chemistry", Beaucage, S. L. et al. (Edrs.), John Wiley & Sons, Inc., New York, N.Y., USA, which is hereby incorporated herein by reference. Specific examples of preferred dsRNA compounds useful in this invention include dsRNAs containing modified backbones or no natural internucleoside linkages. As defined in this specification, dsRNAs having modified backbones include those that retain a phosphorus atom in the backbone and those that do not have a phosphorus atom in the backbone. For the purposes of this specification, and as sometimes referenced in the art, modified dsRNAs that do not have a phosphorus atom in their internucleoside backbone can also be considered to be oligonucleosides.

Preferred modified dsRNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those) having inverted polarity wherein the adjacent pairs of nucleoside units are linked 3'-5' to 5'-3' or 2'-5' to 5'-2'. Various salts, mixed salts and free acid forms are also included.

Representative U.S. patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; and 5,625,050, each of which is herein incorporated by reference Preferred modified dsRNA backbones that do not include a phosphorus atom therein have backbones that are formed by short chain alkyl or cycloalkyl internucleoside linkages, mixed heteroatoms and alkyl or cycloalkyl internucleoside linkages, or ore or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and CH2 component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677,439, each of which is herein incorporated by reference.

In other preferred dsRNA mimetics, both the sugar and the internucleoside linkage, i.e., the backbone, of the nucleotide units are replaced with novel groups. The base units are maintained for hybridization with an appropriate nucleic acid target compound. One such oligomeric compound, an dsRNA mimetic that has been shown to have excellent hybridization properties, is referred to as a peptide nucleic acid (PNA). In PNA compounds, the sugar backbone of an dsRNA is replaced with an amide containing backbone, in particular an aminoethylglycine backbone. The nucleobases are retained and are bound directly or indirectly to aza nitrogen atoms of the amide portion of the backbone. Representative U.S. patents that teach the preparation of PNA compounds include, but are not limited to, U.S. Pat. Nos. 5,539,082; 5,714,331; and 5,719,262, each of which is herein incorporated by reference. Further teaching of PNA compounds can be found in Nielsen et al., Science, 1991, 254, 1497-1500.

Most preferred embodiments of the invention are dsRNAs with phosphorothioate backbones and oligonucleosides with heteroatom backbones, and in particular —$CH_2$—NH—$CH_2$—, —$CH_2$—N($CH_3$)—O—$CH_2$—[known as a methylene (methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$—$CH_2$—[wherein the native phosphodiester backbone is represented as —O—P—O—$CH_2$—] of the above-referenced U.S. Pat. No. 5,489,677, and the amide backbones of the above-referenced U.S. Pat. No. 5,602,240. Also preferred are dsRNAs having morpholino backbone structures of the above-referenced U.S. Pat. No. 5,034,506.

Modified dsRNAs may also contain one or more substituted sugar moieties. Preferred dsRNAs comprise one of the following at the 2' position: OH; F; O-, S-, or N-alkyl; O-, S-, or N-alkenyl; O—, S- or N-alkynyl; or O-alkyl-O-alkyl, wherein the alkyl, alkenyl and alkynyl may be substituted or unsubstituted $C_1$ to $C_{10}$ alkyl or $C_2$ to $C_{10}$ alkenyl and alkynyl. Particularly preferred are O[($CH_2$)$_n$O]$_m$$CH_3$, O($CH_2$)$_n$OCH$_3$, O($CH_2$)$_n$NH$_2$, O($CH_2$)$_n$CH$_3$, O($CH_2$)$_n$ONH$_2$, and O($CH_2$)$_n$ON[($CH_2$)$_n$CH$_3$)]$_2$, where n and m are from 1 to about 10. Other preferred dsRNAs comprise one of the following at the 2' position: $C_1$ to $C_{10}$ lower alkyl, substituted lower alkyl, alkaryl, aralkyl, O-alkaryl or O-aralkyl, SH, SCH$_3$, OCN, Cl, Br, CN, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group for improving the pharmacokinetic properties of an dsRNA, or a group for improving the pharmacodynamic properties of an dsRNA, and other substituents having similar properties. A preferred modification includes 2'-methoxyethoxy (2'-O—CH$_2$CH$_2$OCH$_3$, also known as 2'-O-(2-methoxyethyl) or 2'-MOE) (Martin et al., Helv. Chim. Acta, 1995, 78, 486-504) i.e., an alkoxy-alkoxy group. A further preferred modification includes 2'-dimethylaminooxyethoxy, i.e., a O(CH$_2$)$_2$ON (CH$_3$)$_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—CH$_2$—O—CH$_2$—N(CH$_2$)$_2$, also described in examples herein below.

Other preferred modifications include 2'-methoxy (2'-OCH$_3$), 2'-aminopropoxy (2'-OCH$_2$CH$_2$CH$_2$NH$_2$) and 2'-fluoro (2'-F). Similar modifications may also be made at other positions on the dsRNA, particularly the 3' position of the sugar on the 3' terminal nucleotide or in 2'-5' linked dsRNAs and the 5' position of 5' terminal nucleotide. DsRNAs may also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application, and each of which is herein incorporated by reference in its entirety.

DsRNAs may also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosine's, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in The Concise Encyclopedia Of Polymer Science And Engineering, pages 858-859, Kroschwitz, J. L, ed. John Wiley & Sons, 1990, these disclosed by Englisch et al., Angewandte Chemie, International Edition, 1991, 30, 613, and those disclosed by Sanghvi, Y S., Chapter 15, DsRNA Research and Applications, pages 289-302, Crooke, S. T. and Lebleu, B., Ed., CRC Press, 1993. Certain of these nucleobases are particularly useful for increasing the binding affinity of the oligomeric compounds of the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., DsRNA Research and Applications, CRC Press, Boca Raton, 1993, pp. 276-278) and are presently preferred base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. No. 3,687,808, as well as U.S. Pat. Nos. 4,845,205; 5,130,30; 5,134,066; 5,175,273; 5,367,066; 5,432,272; 5,457,187; 5,459,255; 5,484,908; 5,502,177; 5,525,711; 5,552,540; 5,587,469; 5,594,121; 5,596,091; 5,614,617; and 5,681,941, each of which is herein incorporated by reference, and U.S. Pat. No. 5,750,692, also herein incorporated by reference.

Conjugates

Another modification of the dsRNAs of the invention involves chemically linking to the dsRNA one or more moieties or conjugates which enhance the activity, cellular distribution or cellular uptake of the dsRNA. Such moieties include but are not limited to lipid moieties such as a cholesterol moiety (Letsinger et al., Proc. Natl. Acid. Sci. USA, 199, 86, 6553-6556), cholic acid (Manoharan et al., Biorg. Med. Chem. Let., 1994 4 1053-1060), a thioether, e.g., beryl-5-tritylthiol (Manoharan et al., Ann. N.Y. Acad. Sci., 1992, 660, 306-309; Manoharan et al., Biorg. Med. Chem. Let., 1993, 3, 2765-2770), a thiocholesterol (Oberhauser et al., Nucl. Acids Res., 1992, 20, 533-538), an aliphatic chain, e.g., dodecandiol or undecyl residues (Saison-Behmoaras et al., EMBO J, 1991, 10, 1111-1118; Kabanov et al., FEBS Lett., 1990, 259, 327-330; Svinarchuk et al., Biochimie, 1993, 75, 49-54), a phospholipid, e.g., di-hexadecyl-rac-glycerol or triethyl-ammonium 1,2-di-O-hexadecyl-rac-glycero-3-Hphosphonate (Manoharan et al., Tetrahedron Lett., 1995, 36, 3651-3654; Shea et al., Nucl. Acids Res., 1990, 18, 3777-3783), a polyamine or a polyethylene glycol chain (Manoharan et al., Nucleosides & Nucleotides, 1995, 14, 969-973), or adamantane acetic acid (Manoharan et al., Tetrahedron Lett., 1995, 36, 3651-3654), a palmityl moiety (Mishra et al., Biochim. Biophys. Acta, 1995, 1264, 229-237), or an octadecylamine or hexylamino-carbonyloxycholesterol moiety (Crooke et al., J. Pharmacol. Exp. Ther., 1996, 277, 923-937).

Representative U.S. patents that teach the preparation of such dsRNA conjugates include, but are not limited to, U.S. Pat. Nos. 4,828,979; 4,948,882; 5,218,105; 5,525,465; 5,541, 313; 5,545,730; 5,552,538; 5,578,717, 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203; 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941, each of which is herein incorporated by reference.

It is not necessary for all positions in a given compound to be uniformly modified, and in fact more than one of the aforementioned modifications may be incorporated in a single compound or even at a single nucleoside within an dsRNA. The present invention also includes dsRNA compounds which are chimeric compounds. "Chimeric" dsRNA compounds or "chimeras," in the context of this invention, are dsRNA compounds, particularly dsRNAs, which contain two or more chemically distinct regions, each made up of at least one monomer unit, i.e., a nucleotide in the case of an dsRNA compound. These dsRNAs typically contain at least one region wherein the dsRNA is modified so as to confer upon the dsRNA increased resistance to nuclease degradation, increased cellular uptake, and/or increased binding affinity for the target nucleic acid. An additional region of the dsRNA may serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of dsRNA inhibition of gene expression. Consequently, comparable results can often be obtained with shorter dsRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the dsRNA may be modified by a non-ligand group. A number of non-ligand molecules have been conjugated to dsRNAs in order to enhance the activity, cellular distribution or cellular uptake of the dsRNA, and procedures for performing such conjugations are available in the scientific literature. Such non-ligand moieties have included lipid moieties, such as cholesterol (Letsinger et al., Proc. Natl. Acad. Sci. USA, 1989, 86:6553), cholic acid (Manoharan et al., Bioorg. Med. Chem. Lett., 1994, 4:1053), a thioether, e.g., hexyl-5-tritylthiol (Manoharan et al., Ann. N.Y. Acad. Sci., 1992, 660:306; Manoharan et al., Bioorg. Med. Chem. Lett., 1993, 3:2765), a thiocholesterol (Oberhauser et al., Nucl. Acids Res., 1992, 20:533), an aliphatic chain, e.g., dodecandiol or undecyl residues (Saison-Behmoaras et al., EMBO J., 1991, 10:111; Kabanov et al., FEBS Lett., 1990, 259:327; Svinarchuk et al., Biochimie, 1993, 75:49), a phospholipid, e.g., di-hexadecyl-rac-glycerol or triethylammonium 1,2-di-O-hexadecyl-rac-glycero-3-H-phosphonate (Manoharan et al., Tetrahedron Lett., 1995, 36:3651; Shea et al., Nucl. Acids Res., 1990, 18:3777), a polyamine or a polyethylene glycol chain (Manoharan et al., Nucleosides & Nucleotides, 1995, 14:969), or adamantane acetic acid (Manoharan et al., Tetrahedron Lett., 1995, 36:3651), a palmityl moiety (Mishra et al., Biochim. Biophys. Acta, 1995, 1264:229), or an octadecylamine or hexylamino-carbonyl-oxycholesterol moiety (Crooke et al., J. Pharmacol. Exp. Ther., 1996, 277:923). Representative United States patents that teach the preparation of such dsRNA conjugates have been listed above. Typical conjugation protocols involve the synthesis of dsRNAs bearing an aminolinker at one or more positions of the sequence. The amino group is then reacted with the molecule being conjugated using appropriate coupling or activating reagents. The conjugation reaction may be performed either with the dsRNA still bound to the solid support or following cleavage of the dsRNA in solution phase. Purification of the dsRNA conjugate by HPLC typically affords the pure conjugate.

In some cases, a ligand can be multifunctional and/or a dsRNA can be conjugated to more than one ligand. For example, the dsRNA can be conjugated to one ligand for improved uptake and to a second ligand for improved release.

Vector Encoded RNAi Agents

In another aspect of the invention, Eg5 and VEGF specific dsRNA molecules that are expressed from transcription units inserted into DNA or RNA vectors (see, e.g., Couture, A, et al., TIG. (1996), 12:5-10; Skillern, A., et al., International PCT Publication No. WO 00/22113, Conrad, International PCT Publication No. WO 00/22114, and Conrad, U.S. Pat. No. 6,054,299). These transgenes can be introduced as a linear construct, a circular plasmid, or a viral vector, which can be incorporated and inherited as a transgene integrated into the host genome. The transgene can also be constructed to permit it to be inherited as an extrachromosomal plasmid (Gassmann, et al., Proc. Natl. Acad. Sci. USA (1995) 92:1292).

The individual strands of a dsRNA can be transcribed by promoters on two separate expression vectors and co-transfected into a target cell. Alternatively each individual strand of the dsRNA can be transcribed by promoters both of which are located on the same expression plasmid. In a preferred embodiment, a dsRNA is expressed as an inverted repeat joined by a linker polynucleotide sequence such that the dsRNA has a stem and loop structure.

The recombinant dsRNA expression vectors are generally DNA plasmids or viral vectors. dsRNA expressing viral vectors can be constructed based on, but not limited to, adeno-associated virus (for a review, see Muzyczka, et al., *Curr. Topics Micro. Immunol.* (1992) 158:97-129)); adenovirus (see, for example, Berkner, et al., *BioTechniques* (1998) 6:616), Rosenfeld et al. (1991, *Science* 252:431-434), and Rosenfeld et al. (1992, *Cell* 68:143-155)); or alphavirus as well as others known in the art. Retroviruses have been used to introduce a variety of genes into many different cell types, including epithelial cells, in vitro and/or in vivo (see, e.g., Eglitis, et al., *Science* (1985) 230:1395-1398; Danos and Mulligan, *Proc. Natl. Acad. Sci. USA* (1998) 85:6460-6464; Wilson et al., 1988, *Proc. Natl. Acad. Sci. USA* 85:3014-3018; Armentano et al., 1990, *Proc. Natl. Acad. Sci. USA* 87:61416145; Huber et al., 1991, *Proc. Natl. Acad. Sci. USA* 88:8039-8043; Ferry et al., 1991, *Proc. Natl. Acad. Sci. USA* 88:8377-8381; Chowdhury et al., 1991, *Science* 254:1802-1805; van Beusechem. et al., 1992, *Proc. Natl. Acad. Sci. USA* 89:7640-19; Kay et al., 1992, *Human Gene Therapy* 3:641-647; Dai et al., 1992, *Proc. Natl. Acad. Sci. USA* 89:10892-10895; Hwu et al., 1993, *J. Immunol.* 150:4104-4115; U.S. Pat. No. 4,868,116; U.S. Pat. No. 4,980,286; PCT Application WO 89/07136; PCT Application WO 89/02468; PCT Application WO 89/05345; and PCT Application WO 92/07573). Recombinant retroviral vectors capable of transducing and expressing genes inserted into the genome of a cell can be produced by transfecting the recombinant retroviral genome into suitable packaging cell lines such as PA317 and Psi-CRIP (Comette et al., 1991, Human Gene Therapy 2:5-10; Cone et al., 1984, Proc. Natl. Acad. Sci. USA 81:6349). Recombinant adenoviral vectors can be used to infect a wide variety of cells and tissues in susceptible hosts (e.g., rat, hamster, dog, and chimpanzee) (Hsu et al., 1992, J. Infectious Disease, 166:769), and also have the advantage of not requiring mitotically active cells for infection.

Any viral vector capable of accepting the coding sequences for the dsRNA molecule(s) to be expressed can be used, for example vectors derived from adenovirus (AV); adeno-associated virus (AAV); retroviruses (e.g., lentiviruses (LV), Rhabdoviruses, murine leukemia virus); herpes virus, and the like. The tropism of viral vectors can be modified by pseudotyping the vectors with envelope proteins or other surface antigens from other viruses, or by substituting different viral capsid proteins, as appropriate.

For example, lentiviral vectors of the invention can be pseudotyped with surface proteins from vesicular stomatitis virus (VSV), rabies, Ebola, Mokola, and the like. AAV vectors of the invention can be made to target different cells by engineering the vectors to express different capsid protein serotypes. For example, an AAV vector expressing a serotype 2 capsid on a serotype 2 genome is called AAV 2/2. This serotype 2 capsid gene in the AAV 2/2 vector can be replaced by a serotype 5 capsid gene to produce an AAV 2/5 vector. Techniques for constructing AAV vectors which express different capsid protein serotypes are within the skill in the art; see, e.g., Rabinowitz J E et al. (2002), J Virol 76:791-801, the entire disclosure of which is herein incorporated by reference.

Selection of recombinant viral vectors suitable for use in the invention, methods for inserting nucleic acid sequences for expressing the dsRNA into the vector, and methods of delivering the viral vector to the cells of interest are within the skill in the art. See, for example, Dornburg R (1995), Gene Therap. 2: 301-310; Eglitis M A (1988), Biotechniques 6: 608-614; Miller A D (1990), Hum Gene Therap. 1: 5-14; Anderson W F (1998), Nature 392: 25-30; and Rubinson D A et al., Nat. Genet. 33: 401-406, the entire disclosures of which are herein incorporated by reference.

Preferred viral vectors are those derived from AV and AAV. In a particularly preferred embodiment, the dsRNA of the invention is expressed as two separate, complementary single-stranded RNA molecules from a recombinant AAV vector having, for example, either the U6 or H1 RNA promoters, or the cytomegalovirus (CMV) promoter.

A suitable AV vector for expressing the dsRNA of the invention, a method for constructing the recombinant AV vector, and a method for delivering the vector into target cells, are described in Xia H et al. (2002), Nat. Biotech. 20: 1006-1010.

Suitable AAV vectors for expressing the dsRNA of the invention, methods for constructing the recombinant AV vector, and methods for delivering the vectors into target cells are described in Samulski R et al. (1987), J. Virol. 61: 3096-3101; Fisher K J et al. (1996), J. Virol, 70: 520-532; Samulski R et al. (1989), J. Virol. 63: 3822-3826; U.S. Pat. No. 5,252,479; U.S. Pat. No. 5,139,941; International Patent Application No. WO 94/13788; and International Patent Application No. WO 93/24641, the entire disclosures of which are herein incorporated by reference.

The promoter driving dsRNA expression in either a DNA plasmid or viral vector of the invention may be a eukaryotic RNA polymerase I (e.g. ribosomal RNA promoter), RNA polymerase II (e.g. CMV early promoter or actin promoter or U1 snRNA promoter) or generally RNA polymerase III promoter (e.g. U6 snRNA or 7SK RNA promoter) or a prokaryotic promoter, for example the T7 promoter, provided the expression plasmid also encodes T7 RNA polymerase required for transcription from a T7 promoter. The promoter can also direct transgene expression to the pancreas (see, e.g., the insulin regulatory sequence for pancreas (Bucchini et al., 1986, Proc. Natl. Acad. Sci. USA 83:2511-2515)).

In addition, expression of the transgene can be precisely regulated, for example, by using an inducible regulatory sequence and expression systems such as a regulatory sequence that is sensitive to certain physiological regulators, e.g., circulating glucose levels, or hormones (Docherty et al., 1994, FASEB J. 8:20-24). Such inducible expression systems, suitable for the control of transgene expression in cells or in mammals include regulation by ecdysone, by estrogen, progesterone, tetracycline, chemical inducers of dimerization, and isopropyl-beta-D1-thiogalactopyranoside (EPTG). A person skilled in the art would be able to choose the appropriate regulatory/promoter sequence based on the intended use of the dsRNA transgene.

Generally, recombinant vectors capable of expressing dsRNA molecules are delivered as described below, and persist in target cells. Alternatively, viral vectors can be used that provide for transient expression of dsRNA molecules. Such vectors can be repeatedly administered as necessary. Once expressed, the dsRNAs bind to target RNA and modulate its function or expression. Delivery of dsRNA expressing vectors can be systemic, such as by intravenous or intramuscular administration, by administration to target cells ex-planted from the patient followed by reintroduction into the patient, or by any other means that allows for introduction into a desired target cell.

dsRNA expression DNA plasmids are typically transfected into target cells as a complex with cationic lipid carriers (e.g. Oligofectamine) or non-cationic lipid-based carriers (e.g. Transit-TKO™). Multiple lipid transfections for dsRNA-mediated knockdowns targeting different regions of a single EG5 gene (or VEGF gene) or multiple Eg5 genes (or VEGF genes) over a period of a week or more are also contemplated by the invention. Successful introduction of the vectors of the invention into host cells can be monitored using various known methods. For example, transient transfection. can be signaled with a reporter, such as a fluorescent marker, such as Green Fluorescent Protein (GFP). Stable transfection of ex vivo cells can be ensured using markers that provide the transfected cell with resistance to specific environmental factors (e.g., antibiotics and drugs), such as hygromycin B resistance.

The Eg5 specific dsRNA molecules and VEGF specific dsRNA molecules can also be inserted into vectors and used as gene therapy vectors for human patients. Gene therapy vectors can be delivered to a subject by, for example, intravenous injection, local administration (see U.S. Pat. No. 5,328,470) or by stereotactic injection (see e.g., Chen et al. (1994) Proc. Natl. Acad. Sci. USA 91:3054-3057). The pharmaceutical preparation of the gene therapy vector can include the gene therapy vector in an acceptable diluent, or can include a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

Pharmaceutical Compositions Containing dsRNA

In one embodiment, the invention provides pharmaceutical compositions containing a dsRNA, as described herein, and a pharmaceutically acceptable carrier and methods of administering the same. The pharmaceutical composition containing the dsRNA is useful for treating a disease or disorder associated with the expression or activity of a Eg5/KSP and/or VEGF gene, such as pathological processes mediated by Eg5/KSP and/or VEGF expression, e.g., liver cancer. Such pharmaceutical compositions are formulated based on the mode of delivery.

Dosage

The pharmaceutical compositions featured herein are administered in dosages sufficient to inhibit expression of EG5/KSP and/or VEGF genes. In general, a suitable dose of dsRNA will be in the range of 0.01 to 200.0 milligrams per kilogram body weight of the recipient per day, generally in the range of 1 to 50 mg per kilogram body weight per day. For example, the dsRNA can be administered at 0.01 mg/kg, 0.05 mg/kg, 0.5 mg/kg, 1 mg/kg, 1.5 mg/kg, 2 mg/kg, 3 mg/kg, 5.0 mg/kg, 10 mg/kg, 20 mg/kg, 30 mg/kg, 40 mg/kg, or 50 mg/kg per single dose.

The pharmaceutical composition can be administered once daily, or the dsRNA may be administered as two, three, or more sub-doses at appropriate intervals throughout the day. The effect of a single dose on EG5/KSP AND/OR VEGF levels is long lasting, such that subsequent doses are administered at not more than 7 day intervals, or at not more than 1, 2, 3, or 4 week intervals.

In some embodiments the dsRNA is administered using continuous infusion or delivery through a controlled release formulation. In that case, the dsRNA contained in each sub-dose must be correspondingly smaller in order to achieve the total daily dosage. The dosage unit can also be compounded for delivery over several days, e.g., using a conventional sustained release formulation which provides sustained release of the dsRNA over a several day period. Sustained release formulations are well known in the art and are particularly useful for delivery of agents at a particular site, such as could be used with the agents of the present invention. In this embodiment, the dosage unit contains a corresponding multiple of the daily dose.

The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a composition can include a single treatment or a series of treatments. Estimates of effective dosages and in vivo half-lives for the individual dsRNAs encompassed by the invention can be made using conventional methodologies or on the basis of in vivo testing using an appropriate animal model, as described elsewhere herein.

Advances in mouse genetics have generated a number of mouse models for the study of various human diseases, such as pathological processes mediated by EG5/KSP AND/OR VEGF expression. Such models are used for in vivo testing of dsRNA, as well as for determining a therapeutically effective dose. A suitable mouse model is, for example, a mouse containing a plasmid expressing human EG5/KSP AND/OR VEGF. Another suitable mouse model is a transgenic mouse carrying a transgene that expresses human EG5/KSP AND/OR VEGF.

Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds that exhibit high therapeutic indices are preferred.

The data obtained from cell culture assays and animal studies can be used in formulating a range of dosage for use in humans. The dosage of compositions featured in the invention lies generally within a range of circulating concentrations that include the ED50 with little or no toxicity. The dosage may vary within this range depending upon the dosage form employed and the route of administration utilized. For any compound used in the methods featured in the invention, the therapeutically effective dose can be estimated initially from cell culture assays. A dose may be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

In addition to their administration, as discussed above, the dsRNAs featured in the invention can be administered in combination with other known agents effective in treatment of pathological processes mediated by target gene expression. In any event, the administering physician can adjust the amount and timing of dsRNA administration on the basis of results observed using standard measures of efficacy known in the art or described herein.

Administration

The pharmaceutical compositions of the present invention may be administered in a number of ways depending upon whether local or systemic treatment is desired and upon the area to be treated. Administration may be topical, pulmonary, e.g., by inhalation or insufflation of powders or aerosols, including by nebulizer; intratracheal, intranasal, epidermal and transdermal, and subdermal, oral or parenteral, e.g., subcutaneous.

Typically, when treating a mammal with hyperlipidemia, the dsRNA molecules are administered systemically via parental means. Parenteral administration includes intravenous, intra-arterial, subcutaneous, intraperitoneal or intramuscular injection or infusion; or intracranial, e.g., intraparenchymal, intrathecal or intraventricular, administration. For example, dsRNAs, conjugated or unconjugate or formulated with or without liposomes, can be administered intravenously to a patient. For such, a dsRNA molecule can be formulated into compositions such as sterile and non-sterile aqueous solutions, non-aqueous solutions in common solvents such as alcohols, or solutions in liquid or solid oil bases. Such solutions also can contain buffers, diluents, and other suitable additives. For parenteral, intrathecal, or intraventricular administration, a dsRNA molecule can be formulated into compositions such as sterile aqueous solutions, which also can contain buffers, diluents, and other suitable additives (e.g., penetration enhancers, carrier compounds, and other pharmaceutically acceptable carriers). Formulations are described in more detail herein.

The dsRNA can be delivered in a manner to target a particular tissue, such as the liver (e.g., the hepatocytes of the liver).

Formulations

The pharmaceutical formulations of the present invention, which may conveniently be presented in unit dosage form, may be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions of the present invention may be formulated into any of many possible dosage forms such as, but not limited to, tablets, capsules, gel capsules, liquid syrups, soft gels, suppositories, and enemas. The compositions of the present invention may also be formulated as suspensions in aqueous, non-aqueous or mixed media. Aqueous suspensions may further contain substances which increase the viscosity of the suspension including, for example, sodium carboxymethylcellulose, sorbitol and/or dextran. The suspension may also contain stabilizers.

Pharmaceutical compositions of the present invention include, but are not limited to, solutions, emulsions, and liposome-containing formulations. These compositions may be generated from a variety of components that include, but are not limited to, preformed liquids, self-emulsifying solids and self-emulsifying semisolids. In one aspect are formulations that target the liver when treating hepatic disorders such as hyperlipidemia.

In addition, dsRNA that target the EG5/KSP AND/OR VEGF gene can be formulated into compositions containing the dsRNA admixed, encapsulated, conjugated, or otherwise associated with other molecules, molecular structures, or mixtures of nucleic acids. For example, a composition containing one or more dsRNA agents that target the Eg5/KSP and/or VEGF gene can contain other therapeutic agents such as other cancer therapeutics or one or more dsRNA compounds that target non-EG5/KSP AND/OR VEGF genes.

Oral, Parenteral, Topical, and Biologic Formulations

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders may be desirable. In some embodiments, oral formulations are those in which dsRNAs featured in the invention are administered in conjunction with one or more penetration enhancers surfactants and chelators. Suitable surfactants include fatty acids and/or esters or salts thereof, bile acids and/or salts thereof. Suitable bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether. DsRNAs featured in the invention may be delivered orally, in granular form including sprayed dried particles, or complexed to form micro or nanoparticles. DsRNA complexing agents include poly-amino acids; polyimines; polyacrylates; polyalkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Suitable complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g., p-amino), poly(methylcyanoacrylate), poly(ethylcyanoacrylate), poly(butylcyanoacrylate), poly(isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. Pat. No. 6,887,906, U.S. patent publication. No. 20030027780, and U.S. Pat. No. 6,747,014, each of which is incorporated herein by reference.

Compositions and formulations for parenteral, intraparenchymal (into the brain), intrathecal, intraventricular or intrahepatic administration may include sterile aqueous solutions which may also contain buffers, diluents and other suitable additives such as, but not limited to, penetration enhancers, carrier compounds and other pharmaceutically acceptable carriers or excipients.

Pharmaceutical compositions and formulations for topical administration may include transdermal patches, ointments, lotions, creams, gels, drops, suppositories, sprays, liquids and powders. Conventional pharmaceutical carriers, aqueous, powder or oily bases, thickeners and the like may be necessary or desirable. Suitable topical formulations include those in which the dsRNAs featured in the invention are in admixture with a topical delivery agent such as lipids, liposomes, fatty acids, fatty acid esters, steroids, chelating agents and surfactants. Suitable lipids and liposomes include neutral (e.g., dioleoylphosphatidyl DOPE ethanolamine, dimyristoylphosphatidyl choline DMPC, distearolyphosphatidyl choline) negative (e.g., dimyristoylphosphatidyl glycerol DMPG) and cationic (e.g., dioleoyltetramethylaminopropyl DOTAP and dioleoylphosphatidyl ethanolamine DOTMA). DsRNAs featured in the invention may be encapsulated within liposomes or may form complexes thereto, in particular to cationic liposomes. Alternatively, dsRNAs may be complexed to lipids, in particular to cationic lipids. Suitable fatty acids and esters include but are not limited to arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a $C_{1-10}$ alkyl ester (e.g., isopropylmyristate IPM), monoglyceride, diglyceride or pharmaceutically acceptable salt thereof. Topical formulations are described in detail in U.S. Pat. No. 6,747,014, which is incorporated herein by reference. In addition, dsRNA molecules can be administered to a mammal as biologic or abiologic means as described in, for example, U.S. Pat. No. 6,271,359. Abiologic delivery can be accomplished by a variety of methods including, without limitation, (1) loading liposomes with a dsRNA acid molecule provided herein and (2) complexing a dsRNA molecule with lipids or liposomes to form nucleic acid-lipid or nucleic acid-liposome complexes. The liposome can be composed of cationic and neutral lipids commonly used to transfect cells in vitro. Cationic lipids can complex (e.g., charge-associate) with negatively charged nucleic acids to form liposomes. Examples of cationic liposomes include, without limitation, lipofectin, lipofectamine, lipofectace, and DOTAP. Procedures for forming liposomes are well known in the art. Liposome compositions can be formed, for example, from phosphatidylcholine, dimyristoyl phosphatidylcholine, dipalmitoyl phosphatidylcholine, dimyristoyl phosphatidylglycerol, or dioleoyl phosphatidylethanolamine. Numerous lipophilic agents are commercially available, including Lipofectin™ (Invitrogen/Life Technologies, Carlsbad, Calif.) and Effectene™ (Qiagen, Valencia, Calif.). In addition, systemic delivery methods can be optimized using commercially available cationic lipids such as DDAB or DOTAP, each of which can be mixed with a neutral lipid such as DOPE or cholesterol. In some cases, liposomes such as those described by Templeton et al. (Nature Biotechnology, 15: 647-652 (1997)) can be used. In other embodiments, polycations such as polyethyleneimine can be used to achieve delivery in vivo and ex vivo (Boletta et al., J. Am. Soc. Nephrol. 7: 1728 (1996)). Additional information regarding the use of liposomes to deliver nucleic acids can be found in U.S. Pat. No. 6,271,359, PCT Publication WO 96/40964 and Morrissey, D. et al. 2005. Nat. Biotechnol. 23(8):1002-7.

Biologic delivery can be accomplished by a variety of methods including, without limitation, the use of viral vectors. For example, viral vectors (e.g., adenovirus and herpesvirus vectors) can be used to deliver dsRNA molecules to liver cells. Standard molecular biology techniques can be used to introduce one or more of the dsRNAs provided herein into one of the many different viral vectors previously developed to deliver nucleic acid to cells. These resulting viral vectors can be used to deliver the one or more dsRNAs to cells by, for example, infection.

Characterization of Formulated dsRNAs

Formulations prepared by either the in-line mixing or extrusion-free method can be characterized in similar manners. For example, formulations are typically characterized by visual inspection. They should be whitish translucent solutions free from aggregates or sediment. Particle size and particle size distribution of lipid-nanoparticles can be measured by light scattering using, for example, a Malvern Zetasizer Nano ZS (Malvern, USA). Particles should be about 20-300 nm, such as 40-100 nm in size. The particle size distribution should be unimodal. The total siRNA concentration in the formulation, as well as the entrapped fraction, is estimated using a dye exclusion assay. A sample of the formulated siRNA can be incubated with an RNA-binding dye, such as Ribogreen (Molecular Probes) in the presence or absence of a formulation disrupting surfactant, e.g., 0.5% Triton-X100. The total siRNA in the formulation can be determined by the signal from the sample containing the surfactant, relative to a standard curve. The entrapped fraction is determined by subtracting the "free" siRNA content (as measured by the signal in the absence of surfactant) from the total siRNA content. Percent entrapped siRNA is typically >85%. For SNALP formulation, the particle size is at least 30 nm, at least 40 nm, at least 50 nm, at least 60 nm, at least 70 nm, at least 80 nm, at least 90 nm, at least 100 nm, at least 110 nm, and at least 120 nm. The suitable range is typically about at least 50 nm to about at least 110 nm, about at least 60 nm to about at least 100 nm, or about at least 80 nm to about at least 90 nm.

Liposomal Formulations

There are many organized surfactant structures besides microemulsions that have been studied and used for the formulation of drugs. These include monolayers, micelles, bilayers and vesicles. Vesicles, such as liposomes, have attracted great interest because of their specificity and the duration of action they offer from the standpoint of drug delivery. As used in the present invention, the term "liposome" means a vesicle composed of amphiphilic lipids arranged in a spherical bilayer or bilayers.

Liposomes are unilamellar or multilamellar vesicles which have a membrane formed from a lipophilic material and an aqueous interior. The aqueous portion contains the composition to be delivered. Cationic liposomes possess the advantage of being able to fuse to the cell wall. Non-cationic liposomes, although not able to fuse as efficiently with the cell wall, are taken up by macrophages in vivo.

In order to cross intact mammalian skin, lipid vesicles must pass through a series of fine pores, each with a diameter less than 50 nm, under the influence of a suitable transdermal gradient. Therefore, it is desirable to use a liposome which is highly deformable and able to pass through such fine pores.

Further advantages of liposomes include; liposomes obtained from natural phospholipids are biocompatible and biodegradable; liposomes can incorporate a wide range of water and lipid soluble drugs; liposomes can protect encapsulated drugs in their internal compartments from metabolism and degradation (Rosoff, in Pharmaceutical Dosage Forms, Lieberman, Rieger and Banker (Eds.), 1988, Marcel Dekker, Inc., New York, N.Y., volume 1, p. 245). Important considerations in the preparation of liposome formulations are the lipid surface charge, vesicle size and the aqueous volume of the liposomes.

Liposomes are useful for the transfer and delivery of active ingredients to the site of action. Because the liposomal membrane is structurally similar to biological membranes, when liposomes are applied to a tissue, the liposomes start to merge with the cellular membranes and as the merging of the liposome and cell progresses, the liposomal contents are emptied into the cell where the active agent may act.

Liposomal formulations have been the focus of extensive investigation as the mode of delivery for many drugs. There is growing evidence that for topical administration, liposomes present several advantages over other formulations. Such advantages include reduced side-effects related to high systemic absorption of the administered drug, increased accumulation of the administered drug at the desired target, and the ability to administer a wide variety of drugs, both hydrophilic and hydrophobic, into the skin.

Several reports have detailed the ability of liposomes to deliver agents including high-molecular weight DNA into the skin. Compounds including analgesics, antibodies, hormones and high-molecular weight DNAs have been administered to the skin. The majority of applications resulted in the targeting of the upper epidermis Liposomes fall into two broad classes. Cationic liposomes are positively charged liposomes which interact with the negatively charged DNA molecules to form a stable complex. The positively charged DNA/liposome complex binds to the negatively charged cell surface and is internalized in an endosome. Due to the acidic pH within the endosome, the liposomes are ruptured, releasing their contents into the cell cytoplasm (Wang et al., Biochem. Biophys. Res. Commun., 1987, 147, 980-985).

Liposomes which are pH-sensitive or negatively-charged, entrap DNA rather than complex with it. Since both the DNA and the lipid are similarly charged, repulsion rather than complex formation occurs. Nevertheless, some DNA is entrapped within the aqueous interior of these liposomes. pH-sensitive liposomes have been used to deliver DNA encoding the thymidine kinase gene to cell monolayers in culture. Expression of the exogenous gene was detected in the target cells (Zhou et al., Journal of Controlled Release, 1992, 19, 269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

Several studies have assessed the topical delivery of liposomal drug formulations to the skin. Application of liposomes containing interferon to guinea pig skin resulted in a reduction of skin herpes sores while delivery of interferon via other means (e.g., as a solution or as an emulsion) were ineffective (Weiner et al., Journal of Drug Targeting, 1992, 2, 405-410). Further, an additional study tested the efficacy of interferon administered as part of a liposomal formulation to the administration of interferon using an aqueous system, and concluded that the liposomal formulation was superior to aqueous administration (du Plessis et al., Antiviral Research, 1992, 18, 259-265).

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/po-lyoxyethylene-10-stearyl ether) and Novasome™ II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cyclosporin-A into different layers of the skin (Hu et al. S.T.P. Pharma. Sci., 1994, 4, 6, 466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., FEBS Letters, 1987, 223, 42; Wu et al., Cancer Research, 1993, 53, 3765).

Various liposomes comprising one or more glycolipids are known in the art. Papahadjopoulos et al. (Ann. N.Y. Acad. Sci., 1987, 507, 64) reported the ability of monosialoganglioside $G_{M1}$, galactocerebroside sulfate and phosphatidylinositol to improve blood half-lives of liposomes. These findings were expounded upon by Gabizon et al. (Proc. Natl. Acad. Sci. U.S.A., 1988, 85, 6949). U.S. Pat. No. 4,837,028 and WO 88/04924, both to Allen et al., disclose liposomes comprising (1) sphingomyelin and (2) the ganglioside $G_M1$ or a galactocerebroside sulfate ester. U.S. Pat. No. 5,543,152 (Webb et al.) discloses liposomes comprising sphingomyelin. Liposomes comprising 1,2-sn-dimyristoylphosphat-idylcholine are disclosed in WO 97/13499 (Lim et al).

Many liposomes comprising lipids derivatized with one or more hydrophilic polymers, and methods of preparation thereof, are known in the art. Sunamoto et al. (Bull. Chem. Soc. Jpn., 1980, 53, 2778) described liposomes comprising a nonionic detergent, $2C_{1215G}$, that contains a PEG moiety. Illum et al. (FEBS Lett., 1984, 167, 79) noted that hydrophilic coating of polystyrene particles with polymeric glycols results in significantly enhanced blood half-lives. Synthetic phospholipids modified by the attachment of carboxylic groups of polyalkylene glycols (e.g., PEG) are described by Sears (U.S. Pat. Nos. 4,426,330 and 4,534,899). Klibanov et al. (FEBS Lett., 1990, 268, 235) described experiments demonstrating that liposomes comprising phosphatidylethanolamine (PE) derivatized with PEG or PEG stearate have significant increases in blood circulation half-lives. Blume et al. (Biochimica et Biophysica Acta, 1990, 1029, 91) extended such observations to other PEG-derivatized phospholipids, e.g., DSPE-PEG, formed from the combination of distearoylphosphatidylethanolamine (DSPE) and PEG. Liposomes having covalently bound PEG moieties on their external surface are described in European Patent No. EP 0 445 131 B1 and WO 90/04384 to Fisher. Liposome compositions containing 1-20 mole percent of PE derivatized with PEG, and methods of use thereof, are described by Woodle et al. (U.S. Pat. Nos. 5,013,556 and 5,356,633) and Martin et al. (U.S. Pat. No. 5,213,804 and European Patent No. EP 0 496 813 B1). Liposomes comprising a number of other lipid-polymer conjugates are disclosed in WO 91/05545 and U.S. Pat. No. 5,225,212 (both to Martin et al.) and in WO 94/20073 (Zalipsky et al.) Liposomes comprising PEG-modified ceramide lipids are described in WO 96/10391 (Choi et al). U.S. Pat. No. 5,540,935 (Miyazaki et al.) and U.S. Pat. No. 5,556,948 (Tagawa et al.) describe PEG-containing liposomes that can be further derivatized with functional moieties on their surfaces.

A number of liposomes comprising nucleic acids are known in the art. WO 96/40062 to Thierry et al. discloses methods for encapsulating high molecular weight nucleic acids in liposomes. U.S. Pat. No. 5,264,221 to Tagawa et al. discloses protein-bonded liposomes and asserts that the contents of such liposomes may include a dsRNA. U.S. Pat. No. 5,665,710 to Rahman et al. describes certain methods of encapsulating oligodeoxynucleotides in liposomes. WO 97/04787 to Love et al. discloses liposomes comprising dsRNAs targeted to the raf gene.

Transfersomes are yet another type of liposomes, and are highly deformable lipid aggregates which are attractive candidates for drug delivery vehicles. Transfersomes may be described as lipid droplets which are so highly deformable that they are easily able to penetrate through pores which are smaller than the droplet. Transfersomes are adaptable to the environment in which they are used, e.g., they are self-optimizing (adaptive to the shape of pores in the skin), self-repairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in Pharmaceutical Dosage Forms, Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in Pharmaceutical Dosage Forms, Marcel Dekker, Inc., New York, N.Y., 1988, p. 285).

SNALPs

In one embodiment, a dsRNA featured in the invention is fully encapsulated in the lipid formulation to form a SPLP, pSPLP, SNALP, or other nucleic acid-lipid particle. As used herein, the term "SNALP" refers to a stable nucleic acid-lipid particle, including SPLP. As used herein, the term "SPLP" refers to a nucleic acid-lipid particle comprising plasmid DNA encapsulated within a lipid vesicle. SNALPs and SPLPs typically contain a cationic lipid, a non-cationic lipid, and a lipid that prevents aggregation of the particle (e.g., a PEG-lipid conjugate). SNALPs and SPLPs are extremely useful for systemic applications, as they exhibit extended circulation lifetimes following intravenous (i.v.) injection and accumulate at distal sites (e.g., sites physically separated from the administration site). SPLPs include "pSPLP," which include an encapsulated condensing agent-nucleic acid complex as set forth in PCT Publication No. WO 00/03683. The particles of the present invention typically have a mean diameter of about 50 nm to about 150 nm, more typically about 60 nm to about 130 nm, more typically about 70 nm to about 110 nm, most typically about 70 to about 90 nm, and are substantially nontoxic. In addition, the nucleic acids when present in the nucleic acid-lipid particles of the present invention are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; and PCT Publication No. WO 96/40964.

In one embodiment, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1.

The cationic lipid may be, for example, N,N-dioleyl-N,N-dimethylammonium chloride (DODAC), N,N-distearyl-N,N-dimethylammonium bromide (DDAB), N-(1-(2,3-dioleoyloxy)propyl)-N,N,N-trimethylammonium chloride (DOTAP), N-(1-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-Dilinoleylcarbamoyloxy-3-dimethylaminopropane (DLin-C-DAP), 1,2-Dilinoleyoxy-3-(dimethylamino) acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), 1,2-Dilinoleoyl-3-trimethylaminopropane chloride salt (DLin-TAP.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DMA), 2,2-Dilinoleyl-4-dimethylaminomethyl-[1,3]-dioxolane (DLin-K-DMA) or analogs thereof, or a mixture thereof. The cationic lipid may comprise from about 20 mol % to about 50 mol % or about 40 mol % of the total lipid present in the particle.

In another embodiment, the compound 2,2-Dilinoleyl-4-dimethylaminoethyl-[1,3]-dioxolane can be used to prepare lipid-siRNA nanoparticles. Synthesis of 2,2-Dilinoleyl-4-dimethylaminoethyl-[1,3]-dioxolane is described in U.S. provisional patent application No. 61/107,998 filed on Oct. 23, 2008, which is herein incorporated by reference.

In one embodiment, the lipid-siRNA particle includes 40% 2-Dilinoleyl-4-dimethylaminoethyl-[1,3]-dioxolane: 10% DSPC: 40% Cholesterol: 10% PEG-C-DOMG (mole percent) with a particle size of 63.0±20 nm and a 0.027 siRNA/Lipid Ratio.

The non-cationic lipid may be an anionic lipid or a neutral lipid including, but not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoyl-phosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidyl-ethanolamine (DSPE), 16-O-monomethyl PE, 16-O-dimethyl PE, 18-1-trans PE, 1-stearoyl-2-oleoyl-phosphatidyethanolamine (SOPE), cholesterol, or a mixture thereof. The non-cationic lipid may be from about 5 mol % to about 90 mol %, about 10 mol %, or about 58 mol % if cholesterol is included, of the total lipid present in the particle.

The conjugated lipid that inhibits aggregation of particles may be, for example, a polyethyleneglycol (PEG)-lipid including, without limitation, a PEG-diacylglycerol (DAG), a PEG-dialkyloxypropyl (DAA), a PEG-phospholipid, a PEG-ceramide (Cer), or a mixture thereof. The PEG-DAA conjugate may be, for example, a PEG-dilauryloxypropyl ($C_{12}$), a PEG-dimyristyloxypropyl ($C_{14}$), a PEG-dipalmityloxypropyl ($C_{16}$), or a PEG-distearyloxypropyl ($C_{18}$). The conjugated lipid that prevents aggregation of particles may be from 0 mol % to about 20 mol % or about 2 mol % of the total lipid present in the particle.

In some embodiments, the nucleic acid-lipid particle further includes cholesterol at, e.g., about 10 mol % to about 60 mol % or about 48 mol % of the total lipid present in the particle.

LNP01

In one embodiment, the lipidoid ND98.4HCl (MW 1487) (Formula 1), Cholesterol (Sigma-Aldrich), and PEG-Ceramide C16 (Avanti Polar Lipids) can be used to prepare lipid-siRNA nanoparticles (i.e., LNP01 particles). Stock solutions of each in ethanol can be prepared as follows: ND98, 133 mg/ml; Cholesterol, 25 mg/ml, PEG-Ceramide C16, 100 mg/ml. The ND98, Cholesterol, and PEG-Ceramide C16 stock solutions can then be combined in a, e.g., 42:48:10 molar ratio. The combined lipid solution can be mixed with aqueous siRNA (e.g., in sodium acetate pH 5) such that the final ethanol concentration is about 35-45% and the final sodium acetate concentration is about 100-300 mM. Lipid-siRNA nanoparticles typically form spontaneously upon mixing. Depending on the desired particle size distribution, the resultant nanoparticle mixture can be extruded through a polycarbonate membrane (e.g., 100 nm cut-off) using, for example, a thermobarrel extruder, such as Lipex Extruder (Northern Lipids, Inc). In some cases, the extrusion step can be omitted. Ethanol removal and simultaneous buffer exchange can be accomplished by, for example, dialysis or tangential flow filtration. Buffer can be exchanged with, for example, phosphate buffered saline (PBS) at about pH 7, e.g., about pH 6.9, about pH 7.0, about pH 7.1, about pH 7.2, about pH 7.3, or about pH 7.4.

Formula 1

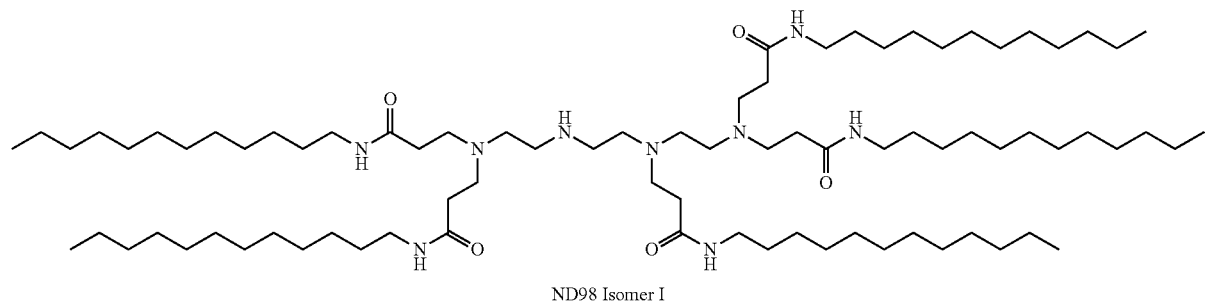

ND98 Isomer I

LNP01 formulations are described, e.g., in International Application Publication No. WO 2008/042973, which is hereby incorporated by reference.

Emulsions

The compositions of the present invention may be prepared and formulated as emulsions. Emulsions are typically heterogeneous systems of one liquid dispersed in another in the form of droplets usually exceeding 0.1 μm in diameter (Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in *Remington's Pharmaceutical Sciences, Mack Publishing Co., Easton, Pa.,* 1985, p. 301). Emulsions are often biphasic systems comprising two immiscible liquid phases intimately mixed and dispersed with each other. In general, emulsions may be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions may contain additional components in addition to the dispersed phases, and the active drug which may be present as a solution in either the aqueous phase, oily phase or itself as a separate phase. Pharmaceutical excipients such as emulsifiers, stabilizers, dyes, and anti-oxidants may also be present in emulsions as needed. Pharmaceutical emulsions may also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion may be a semisolid or a solid, as is the case of emulsion-style ointment bases and creams. Other means of stabilizing emulsions entail the use of emulsifiers that may be incorporated into either phase of the emulsion. Emulsifiers may broadly be classified into four categories: synthetic surfactants, naturally occurring emulsifiers, absorption bases, and finely dispersed solids (Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants may be classified into different classes based on the nature of the hydrophilic group: nonionic, anionic, cationic and amphoteric (Rieger, in Pharmaceutical Dosage Forms, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that may readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used may be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral and parenteral routes and methods for their manufacture have been reviewed in the literature (Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (Rosoff, in Pharmaceutical Dosage Forms, Lieberman, Rieger and Banker (Eds.), 1988, Marcel Dekker, Inc., New York, N.Y., volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins and high fat nutritive preparations are among the materials that have commonly been administered orally as o/w emulsions.

In one embodiment of the present invention, the compositions of dsRNAs and nucleic acids are formulated as microemulsions. A microemulsion may be defined as a system of water, oil and amphiphile which is a single optically isotropic and thermodynamically stable liquid solution (Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sequioleate (SO750), decaglycerol decaoleate (DAO750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions may, however, be prepared without the use of cosurfactants and alcohol-free self-emulsifying microemulsion systems are known in the art. The aqueous phase may typically be, but is not limited to, water, an aqueous solution of the drug, glycerol, PEG300, PEG400, polyglycerols, propylene glycols, and derivatives of ethylene glycol. The oil phase may include, but is not limited to, materials such as Captex 300, Captex 355, Capmul MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (Constantinides et al., Pharmaceutical Research, 1994, 11, 1385-1390; Ritschel, Meth. Find. Exp. Clin. Pharmacol., 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (Constantinides et al., Pharmaceutical Research, 1994, 11, 1385; Ho et al., J. Pharm. Sci., 1996, 85, 138-143). Often microemulsions may form spontaneously when their components are brought together at ambient temperature. This may be particularly advantageous when formulating thermolabile drugs, peptides or dsRNAs. Microemulsions have also been effective in the transdermal delivery of active components in both cosmetic and pharmaceutical applications. It is expected that the microemulsion compositions and formulations of the present invention will facilitate the increased systemic absorption of dsRNAs and nucleic acids from the gastrointestinal tract, as well as improve the local cellular uptake of dsRNAs and nucleic acids.

Microemulsions of the present invention may also contain additional components and additives such as sorbitan monostearate (Grill 3), Labrasol, and penetration enhancers to improve the properties of the formulation and to enhance the absorption of the dsRNAs and nucleic acids of the present invention. Penetration enhancers used in the microemulsions of the present invention may be classified as belonging to one of five broad categories—surfactants, fatty acids, bile salts, chelating agents, and non-chelating non-surfactants (Lee et al., Critical Reviews in Therapeutic Drug Carrier Systems, 1991, p. 92). Each of these classes has been discussed above.

Penetration Enhancers

In one embodiment, the present invention employs various penetration enhancers to effect the efficient delivery of nucleic acids, particularly dsRNAs, to the skin of animals. Most drugs are present in solution in both ionized and non-ionized forms. However, usually only lipid soluble or lipophilic drugs readily cross cell membranes. It has been discovered that even non-lipophilic drugs may cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers may be classified as belonging to one of five broad categories, i.e., surfactants, fatty acids, bile salts, chelating agents, and non-chelating non-surfactants (Lee et al., Critical Reviews in Therapeutic Drug Carrier Systems, 1991, p. 92). Each of the above mentioned classes of penetration enhancers are described below in greater detail.

Surfactants: In connection with the present invention, surfactants (or "surface-active agents") are chemical entities which, when dissolved in an aqueous solution, reduce the surface tension of the solution or the interfacial tension between the aqueous solution and another liquid, with the result that absorption of dsRNAs through the mucosa is enhanced. In addition to bile salts and fatty acids, these penetration enhancers include, for example, sodium lauryl sulfate, polyoxyethylene-9-lauryl ether and polyoxyethylene-20-cetyl ether) (Lee et al., Critical Reviews in Therapeutic Drug Carrier Systems, 1991, p. 92); and perfluorochemical emulsions, such as FC-43. Takahashi et al., J. Pharm. Pharmacol., 1988, 40, 252).

Fatty acids: Various fatty acids and their derivatives which act as penetration enhancers include, for example, oleic acid, lauric acid, capric acid (n-decanoic acid), myristic acid, palmitic acid, stearic acid, linoleic acid, linolenic acid, dicaprate, tricaprate, monoolein (1-monooleoyl-rac-glycerol), dilaurin, caprylic acid, arachidonic acid, glycerol 1-monocaprate, 1-dodecylazacycloheptan-2-one, acylcarnitines, acylcholines, $C_{1-10}$ alkyl esters thereof (e.g., methyl, isopropyl and t-butyl), and mono- and di-glycerides thereof (i.e., oleate, laurate, caprate, myristate, palmitate, stearate, linoleate, etc.) (Lee et al., Critical Reviews in Therapeutic Drug Carryier Systems, 1991, p. 92; Muranishi, Critical Reviews in Therapeutic Drug Carrier Systems, 1990, 7, 1-33; El Hariri et al., J. Pharm. Pharmacol., 1992, 44, 651-654).

Bile salts: The physiological role of bile includes the facilitation of dispersion and absorption of lipids and fat-soluble vitamins (Brunton, Chapter 38 in: Goodman & Gilman's The Pharmacological Basis of Therapeutics, 9th Ed., Hardman et al. Eds., McGraw-Hill, New York, 1996, pp. 934-935). Various natural bile salts, and their synthetic derivatives, act as penetration enhancers. Thus the term "bile salts" includes any of the naturally occurring components of bile as well as any of their synthetic derivatives. Suitable bile salts include, for example, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (Lee et al., Critical Reviews in Therapeutic Drug Carrier Systems, 1991, page 92; Swinyard, Chapter 39 In: Remington's Pharmaceutical Sciences, 18th Ed., Gennaro, ed., Mack Publishing Co., Easton, Pa., 1990, pages 782-783; Muranishi, Critical Reviews in Therapeutic Drug Carrier Systems, 1990, 7, 1-33; Yamamoto et al., J. Pharm. Exp. Ther., 1992, 263, 25; Yamashita et al., J. Pharm. Sci., 1990, 79, 579-583).

Chelating Agents: Chelating agents, as used in connection with the present invention, can be defined as compounds that remove metallic ions from solution by forming complexes therewith, with the result that absorption of dsRNAs through the mucosa is enhanced. With regards to their use as penetration enhancers in the present invention, chelating agents have the added advantage of also serving as DNase inhibitors, as most characterized DNA nucleases require a divalent metal ion for catalysis and are thus inhibited by chelating agents (Jarrett, J. Chromatogr., 1993, 618, 315-339). Suitable chelating agents include but are not limited to disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of beta-diketones (enamines)(Lee et al., Critical Reviews in Therapeutic Drug Carrier Systems, 1991, page 92; Muranishi, Critical Reviews in Therapeutic Drug Carrier Systems, 1990, 7, 1-33; Buur et al., J. Control Rel., 1990, 14, 43-51).

Non-chelating non-surfactants: As used herein, non-chelating non-surfactant penetration enhancing compounds can be defined as compounds that demonstrate insignificant activity as chelating agents or as surfactants but that nonetheless enhance absorption of dsRNAs through the alimentary mucosa (Muranishi, Critical Reviews in Therapeutic Drug Carrier Systems, 1990, 7, 1-33). This class of penetration enhancers include, for example, unsaturated cyclic ureas, 1-alkyl- and 1-alkenylazacyclo-alkanone derivatives (Lee et al., Critical Reviews in Therapeutic Drug Carrier Systems, 1991, page 92); and non-steroidal anti-inflammatory agents such as diclofenac sodium, indomethacin and phenylbutazone (Yamashita et al., J. Pharm. Pharmacol., 1987, 39, 621-626).

Agents that enhance uptake of dsRNAs at the cellular level may also be added to the pharmaceutical and other compositions of the present invention. For example, cationic lipids, such as lipofectin (Junichi et al, U.S. Pat. No. 5,705,188), cationic glycerol derivatives, and polycationic molecules, such as polylysine (Lollo et al., PCT Application WO 97/30731), are also known to enhance the cellular uptake of dsRNAs.

Other agents may be utilized to enhance the penetration of the administered nucleic acids, including glycols such as ethylene glycol and propylene glycol, pyrrols such as 2-pyrrol, azones, and terpenes such as limonene and menthone.

Carriers dsRNAs of the present invention can be formulated in a pharmaceutically acceptable carrier or diluent. A "pharmaceutically acceptable carrier" (also referred to herein as an "excipient") is a pharmaceutically acceptable solvent, suspending agent, or any other pharmacologically inert vehicle. Pharmaceutically acceptable carriers can be liquid or solid, and can be selected with the planned manner of administration in mind so as to provide for the desired bulk, consistency, and other pertinent transport and chemical properties. Typical pharmaceutically acceptable carriers include, by way of example and not limitation: water; saline solution; binding agents (e.g., polyvinylpyrrolidone or hydroxypropyl methylcellulose); fillers (e.g., lactose and other sugars, gelatin, or calcium sulfate); lubricants (e.g., starch, polyethylene glycol, or sodium acetate); disintegrates (e.g., starch or sodium starch glycolate); and wetting agents (e.g., sodium lauryl sulfate).

Certain compositions of the present invention also incorporate carrier compounds in the formulation. As used herein, "carrier compound" or "carrier" can refer to a nucleic acid, or analog thereof, which is inert (i.e., does not possess biological activity per se) but is recognized as a nucleic acid by in vivo processes that reduce the bioavailability of a nucleic acid having biological activity by, for example, degrading the biologically active nucleic acid or promoting its removal from circulation. The co-administration of a nucleic acid and a carrier compound, typically with an excess of the latter substance, can result in a substantial reduction of the amount of nucleic acid recovered in the liver, kidney or other extracirculatory reservoirs, presumably due to competition between the carrier compound and the nucleic acid for a common receptor. For example, the recovery of a partially phosphorothioate dsRNA in hepatic tissue can be reduced when it is co-administered with polyinosinic acid, dextran sulfate, polycytidic acid or 4-acetamido-4'isothiocyano-stilbene-2,2'-disulfonic acid (Miyao et al., DsRNA Res. Dev., 1995, 5, 115-121; Takakura et al., DsRNA & Nucl. Acid Drug Dev., 1996, 6, 177-183.

Excipients

In contrast to a carrier compound, a "pharmaceutical carrier" or "excipient" is a pharmaceutically acceptable solvent, suspending agent or any other pharmacologically inert vehicle for delivering one or more nucleic acids to an animal. The excipient may be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipients suitable for non-parenteral administration which do not deleteriously react with nucleic acids can also be used to formulate the compositions of the present invention. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

Formulations for topical administration of nucleic acids may include sterile and non-sterile aqueous solutions, non-aqueous solutions in common solvents such as alcohols, or solutions of the nucleic acids in liquid or solid oil bases. The solutions may also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone and the like.

Other Components

The compositions of the present invention may additionally contain other adjunct components conventionally found in pharmaceutical compositions, at their art-established usage levels. Thus, for example, the compositions may contain additional, compatible, pharmaceutically-active materials such as, for example, antipruritics, astringents, local anesthetics or anti-inflammatory agents, or may contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings and/or aromatic substances and the like which do not deleteriously interact with the nucleic acid(s) of the formulation.

Aqueous suspensions may contain substances which increase the viscosity of the suspension including, for example, sodium carboxymethylcellulose, sorbitol and/or dextran. The suspension may also contain stabilizers.

Combination Therapy

In one aspect, a composition of the invention can be used in combination therapy. The term "combination therapy" includes the administration of the subject compounds in further combination with other biologically active ingredients (such as, but not limited to, a second and different antineoplastic agent) and non-drug therapies (such as, but not limited to, surgery or radiation treatment). For instance, the compounds of the invention can be used in combination with other pharmaceutically active compounds, preferably compounds that are able to enhance the effect of the compounds of the invention. The compounds of the invention can be administered simultaneously (as a single preparation or separate preparation) or sequentially to the other drug therapy. In general, a combination therapy envisions administration of two or more drugs during a single cycle or course of therapy.

In one aspect of the invention, the subject compounds may be administered in combination with one or more separate agents that modulate protein kinases involved in various disease states. Examples of such kinases may include, but are not limited to: serine/threonine specific kinases, receptor tyrosine specific kinases and non-receptor tyrosine specific kinases. Serine/threonine kinases include mitogen activated protein kinases (MAPK), meiosis specific kinase (MEK), RAF and aurora kinase. Examples of receptor kinase families include epidermal growth factor receptor (EGFR) (e.g., HER2/neu, HER3, HER4, ErbB, ErbB2, ErbB3, ErbB4, Xmrk, DER, Let23); fibroblast growth factor (FGF) receptor (e.g. FGF-R1, GFF-R2/BEK/CEK3, FGF-R3/CEK2, FGF-R4/TKF, KGF-R); hepatocyte growth/scatter factor receptor (HGFR) (e.g., MET, RON, SEA, SEX); insulin receptor (e.g. IGFI-R); Eph (e.g. CEK5, CEK8, EBK, ECK, EEK, EHK-I, EHK-2, ELK, EPH, ERK, HEK, MDK2, MDK5, SEK); AxI (e.g. Mer/Nyk, Rse); RET; and platelet-derived growth factor receptor (PDGFR) (e.g. PDGFα-R, PDGβ-R, CSF1-R/FMS, SCF-R/C-KIT, VEGF-R/FLT, NEK/FLK1, FLT3/FLK2/STK-1). Non-receptor tyrosine kinase families include, but are not limited to, BCR-ABL (e.g. $p43^{abl}$, ARG); BTK (e.g. ITK/EMT, TEC); CSK, FAK, FPS, JAK, SRC, BMX, FER, CDK and SYK.

In another aspect of the invention, the subject compounds may be administered in combination with one or more agents that modulate non-kinase biological targets or processes. Such targets include histone deacetylases (HDAC), DNA methyltransferase (DNMT), heat shock proteins (e.g., HSP90), and proteosomes.

In one embodiment, subject compounds may be combined with antineoplastic agents (e.g. small molecules, monoclonal antibodies, antisense RNA, and fusion proteins) that inhibit one or more biological targets such as Zolinza, Tarceva, Iressa, Tykerb, Gleevec, Sutent, Sprycel, Nexavar, Sorafenib, CNF2024, RG108, BMS387032, Affinitak, Avastin, Herceptin, Erbitux, AG24322, PD325901, ZD6474, PD 184322, Obatodax, ABT737 and AEE788. Such combinations may enhance therapeutic efficacy over efficacy achieved by any of the agents alone and may prevent or delay the appearance of resistant mutational variants.

In certain preferred embodiments, the compounds of the invention are administered in combination with a chemotherapeutic agent. Chemotherapeutic agents encompass a wide range of therapeutic treatments in the field of oncology. These agents are administered at various stages of the disease for the purposes of shrinking tumors, destroying remaining cancer cells left over after surgery, inducing remission, maintaining remission and/or alleviating symptoms relating to the cancer or its treatment. Examples of such agents include, but are not limited to, alkylating agents such as mustard gas derivatives (Mechlorethamine, cylophosphamide, chlorambucil, melphalan, ifosfamide), ethylenimines (thiotepa, hexamethylmelanine), Alkylsulfonates (Busulfan), Hydrazines and Triazines (Altretamine, Procarbazine, Dacarbazine and Temozolomide), Nitrosoureas (Carmustine, Lomustine and Streptozocin), Ifosfamide and metal salts (Carboplatin, Cisplatin, and Oxaliplatin); plant alkaloids such as Podophyllotoxins (Etoposide and Tenisopide), Taxanes (Paclitaxel and Docetaxel), Vinca alkaloids (Vincristine, Vinblastine, Vindesine and Vinorelbine), and Camptothecan analogs (Irinotecan and Topotecan); anti-tumor antibiotics such as Chromomycins (Dactinomycin and Plicamycin), Anthracyclines (Doxorubicin, Daunorubicin, Epirubicin, Mitoxantrone, Valrubicin and Idarubicin), and miscellaneous antibiotics such as Mitomycin, Actinomycin and Bleomycin; anti-metabolites such as folic acid antagonists (Methotrexate, Pemetrexed, Raltitrexed, Aminopterin), pyrimidine antagonists (5-Fluorouracil, Floxuridine, Cytarabine, Capecitabine, and Gemcitabine), purine antagonists (6-Mercaptopurine and 6-Thioguanine) and adenosine deaminase inhibitors (Cladribine, Fludarabine, Mercaptopurine, Clofarabine, Thioguanine, Nelarabine and Pentostatin); topoisomerase inhibitors such as topoisomerase I inhibitors (Ironotecan, topotecan) and topoisomerase II inhibitors (Amsacrine, etoposide, etoposide phosphate, teniposide); monoclonal antibodies (Alemtuzumab, Gemtuzumab ozogamicin, Rituximab, Trastuzumab, Ibritumomab Tioxetan, Cetuximab, Panitumumab, Tositumomab, Bevacizumab); and miscellaneous anti-neoplasties such as ribonucleotide reductase inhibitors (Hydroxyurea); adrenocortical steroid inhibitor (Mitotane); enzymes (Asparaginase and Pegaspargase); anti-microtubule agents (Estramustine); and retinoids (Bexarotene, Isotretinoin, Tretinoin (ATRA). In certain preferred embodiments, the compounds of the invention are administered in combination with a chemoprotective agent. Chemoprotective agents act to protect the body or minimize the side effects of chemotherapy. Examples of such agents include, but are not limited to, amfostine, mesna, and dexrazoxane.

In one aspect of the invention, the subject compounds are administered in combination with radiation therapy. Radiation is commonly delivered internally (implantation of radioactive material near cancer site) or externally from a machine that employs photon (x-ray or gamma-ray) or particle radiation. Where the combination therapy further comprises radiation treatment, the radiation treatment may be conducted at any suitable time so long as a beneficial effect from the co-action of the combination of the therapeutic agents and radiation treatment is achieved. For example, in appropriate cases, the beneficial effect is still achieved when the radiation treatment is temporally removed from the administration of the therapeutic agents, perhaps by days or even weeks.

It will be appreciated that compounds of the invention can be used in combination with an immunotherapeutic agent. One form of immunotherapy is the generation of an active systemic tumor-specific immune response of host origin by administering a vaccine composition at a site distant from the tumor. Various types of vaccines have been proposed, including isolated tumor-antigen vaccines and anti-idiotype vaccines. Another approach is to use tumor cells from the subject to be treated, or a derivative of such cells (reviewed by Schirrmacher et al. (1995) J. Cancer Res. Clin. Oncol. 121:487). In U.S. Pat. No. 5,484,596, Hanna Jr. et al. claim a method for treating a resectable carcinoma to prevent recurrence or metastases, comprising surgically removing the tumor, dispersing the cells with collagenase, irradiating the cells, and vaccinating the patient with at least three consecutive doses of about $10^7$ cells.

It will be appreciated that the compounds of the invention may advantageously be used in conjunction with one or more adjunctive therapeutic agents. Examples of suitable agents for adjunctive therapy include steroids, such as corticosteroids (amcinonide, betamethasone, betamethasone dipropionate, betamethasone valerate, budesonide, clobetasol, clobetasol acetate, clobetasol butyrate, clobetasol 17-propionate, cortisone, deflazacort, desoximetasone, diflucortolone valerate, dexamethasone, dexamethasone sodium phosphate, desonide, furoate, fluocinonide, fluocinolone acetonide, halcinonide, hydrocortisone, hydrocortisone butyrate, hydrocortisone sodium succinate, hydrocortisone valerate, methyl prednisolone, mometasone, prednicarbate, prednisolone, triamcinolone, triamcinolone acetonide, and halobetasol proprionate); a 5HTi agonist, such as a triptan (e.g. sumatriptan or naratriptan); an adenosine A1 agonist; an EP ligand; an NMDA modulator, such as a glycine antagonist; a sodium channel blocker (e.g. lamotrigine); a substance P antagonist (e.g. an NKi antagonist); a cannabinoid; acetaminophen or phenacetin; a 5-lipoxygenase inhibitor; a leukotriene receptor antagonist; a DMARD (e.g. methotrexate); gabapentin and related compounds; a tricyclic antidepressant (e.g. amitryptilline); a neurone stabilizing antiepileptic drug; a mono-aminergic uptake inhibitor (e.g. venlafaxine); a matrix metalloproteinase inhibitor; a nitric oxide synthase (NOS) inhibitor, such as an iNOS or an nNOS inhibitor; an inhibitor of the release, or action, of tumour necrosis factor α; an antibody therapy, such as a monoclonal antibody therapy; an antiviral agent, such as a nucleoside inhibitor (e.g. lamivudine) or an immune system modulator (e.g. interferon); an opioid analgesic; a local anaesthetic; a stimulant, including caffeine; an H2-antagonist (e.g. ranitidine); a proton pump inhibitor (e.g. omeprazole); an antacid (e.g. aluminium or magnesium hydroxide; an antiflatulent (e.g. simethicone); a decongestant (e.g. phenylephrine, phenylpropanolamine, pseudoephedrine, oxymetazoline, epinephrine, naphazoline, xylometazoline, propylhexedrine, or levo-desoxyephedrine); an antitussive (e.g. codeine, hydrocodone, carmiphen, carbetapentane, or dextramethorphan); a diuretic; or a sedating or non-sedating antihistamine.

The compounds of the invention can be co-administered with siRNA that target other genes. For example, a compound of the invention can be co-administered with an siRNA targeted to a c-Myc gene. In one example, AD-12115 can be co-administered with a c-Myc siRNA. Examples of c-Myc targeted siRNAs are disclosed in U.S. patent application Ser. No. 12/373,039 which is herein incorporated by reference.

Methods for Treating Diseases Caused by Expression of the Eg5 and VEGF Genes

The invention relates in particular to the use of a composition containing at least two dsRNAs, one targeting an Eg5 gene, and one targeting a VEGF gene, for the treatment of a cancer, such as liver cancer, e.g., for inhibiting tumor growth and tumor metastasis. For example, a composition, such as pharmaceutical composition, may be used for the treatment of solid tumors, like intrahepatic tumors such as may occur in cancers of the liver. A composition containing a dsRNA targeting Eg5 and a dsRNA targeting VEGF may also be used to treat other tumors and cancers, such as breast cancer, lung cancer, head and neck cancer, brain cancer, abdominal cancer, colon cancer, colorectal cancer, esophagus cancer, gastrointestinal cancer, glioma, tongue cancer, neuroblastoma, osteosarcoma, ovarian cancer, pancreatic cancer, prostate cancer, retinoblastoma, Wilm's tumor, multiple myeloma and for the treatment of skin cancer, like melanoma, for the treatment of lymphomas and blood cancer. The invention further relates to the use of a composition containing an Eg5 dsRNA and a VEGF dsRNA for inhibiting accumulation of ascites fluid and pleural effusion in different types of cancer, e.g., liver cancer, breast cancer, lung cancer, head cancer, neck cancer, brain cancer, abdominal cancer, colon cancer, colorectal cancer, esophagus cancer, gastrointestinal cancer, glioma, tongue cancer, neuroblastoma, osteosarcoma, ovarian cancer, pancreatic cancer, prostate cancer, retinoblastoma, Wilm's tumor, multiple myeloma, skin cancer, melanoma, lymphomas and blood cancer. Owing to the inhibitory effects on Eg5 and VEGF expression, a composition according to the invention or a pharmaceutical composition prepared therefrom can enhance the quality of life.

In one embodiment, a patient having a tumor associated with AFP expression, or a tumor secreting AFP, e.g., a hepatoma or teratoma, is treated. In certain embodiments, the patient has a malignant teratoma, an endodermal sinus tumor (yolk sac carcinoma), a neuroblastoma, a hepatoblastoma, a heptocellular carcinoma, testicular cancer or ovarian cancer.

The invention furthermore relates to the use of a dsRNA or a pharmaceutical composition thereof, e.g., for treating cancer or for preventing tumor metastasis, in combination with other pharmaceuticals and/or other therapeutic methods, e.g., with known pharmaceuticals and/or known therapeutic methods, such as, for example, those which are currently employed for treating cancer and/or for preventing tumor metastasis. Preference is given to a combination with radiation therapy and chemotherapeutic agents, such as cisplatin, cyclophosphamide, 5-fluorouracil, adriamycin, daunorubicin or tamoxifen.

The invention can also be practiced by including with a specific RNAi agent, in combination with another anti-cancer chemotherapeutic agent, such as any conventional chemotherapeutic agent. The combination of a specific binding agent with such other agents can potentiate the chemotherapeutic protocol. Numerous chemotherapeutic protocols will present themselves in the mind of the skilled practitioner as being capable of incorporation into the method of the invention. Any chemotherapeutic agent can be used, including alkylating agents, antimetabolites, hormones and antagonists, radioisotopes, as well as natural products. For example, the compound of the invention can be administered with antibiotics such as doxorubicin and other anthracycline analogs, nitrogen mustards such as cyclophosphamide, pyrimidine analogs such as 5-fluorouracil, cisplatin, hydroxyurea, taxol and its natural and synthetic derivatives, and the like. As another example, in the case of mixed tumors, such as adenocarcinoma of the breast, where the tumors include gonadotropin-dependent and gonadotropin-independent cells, the compound can be administered in conjunction with leuprolide or goserelin (synthetic peptide analogs of LH-RH). Other antineoplastic protocols include the use of a tetracycline compound with another treatment modality, e.g., surgery, radiation, etc., also referred to herein as "adjunct antineoplastic modalities." Thus, the method of the invention can be employed with such conventional regimens with the benefit of reducing side effects and enhancing efficacy.

Methods for Inhibiting Expression of the Eg5 Gene and the VEGF Gene

In yet another aspect, the invention provides a method for inhibiting the expression of the Eg5 gene and the VEGF gene in a mammal. The method includes administering a composition featured in the invention to the mammal such that expression of the target Eg5 gene and the target VEGF gene is silenced.

In one embodiment, a method for inhibiting Eg5 gene expression and VEGF gene expression includes administering a composition containing two different dsRNA molecules, one having a nucleotide sequence that is complementary to at least a part of an RNA transcript of the Eg5 gene and the other having a nucleotide sequence that is complementary to at least a part of an RNA transcript of the VEGF gene of the mammal to be treated. When the organism to be treated is a mammal such as a human, the composition may be administered by any means known in the art including, but not limited to oral or parenteral routes, including intravenous, intramuscular, subcutaneous, transdermal, airway (aerosol), nasal, rectal, and topical (including buccal and sublingual) administration. In preferred embodiments, the compositions are administered by intravenous infusion or injection.

Unless otherwise defined, all technical and scientific terms used herein have the same meaning as commonly understood by one of ordinary skill in the art to which this invention belongs. Although methods and materials similar or equivalent to those described herein can be used in the practice or testing of the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

Example 1 dsRNA Synthesis

Source of Reagents

Where the source of a reagent is not specifically given herein, such reagent may be obtained from any supplier of reagents for molecular biology at a quality/purity standard for application in molecular biology.

siRNA Synthesis

For screening of dsRNA, single-stranded RNAs were produced by solid phase synthesis on a scale of 1 µmole using an Expedite 8909 synthesizer (Applied Biosystems, Applera Deutschland GmbH, Darmstadt, Germany) and controlled pore glass (CPG, 500 Å, Proligo Biochemie GmbH, Hamburg, Germany) as solid support. RNA and RNA containing 2'-O-methyl nucleotides were generated by solid phase synthesis employing the corresponding phosphoramidites and 2'-O-methyl phosphoramidites, respectively (Proligo Biochemie GmbH, Hamburg, Germany). These building blocks were incorporated at selected sites within the sequence of the oligoribonucleotide chain using standard nucleoside phosphoramidite chemistry such as described in Current protocols in nucleic acid chemistry, Beaucage, S. L. et al. (Edrs.), John Wiley & Sons, Inc., New York, N.Y., USA. Phosphorothioate linkages were introduced by replacement of the iodine oxidizer solution with a solution of the Beaucage reagent (Chruachem Ltd, Glasgow, UK) in acetonitrile (1%). Further ancillary reagents were obtained from Mallinckrodt Baker (Griesheim, Germany).

Deprotection and purification of the crude oligoribonucleotides by anion exchange HPLC were carried out according to established procedures. Yields and concentrations were determined by UV absorption of a solution of the respective RNA at a wavelength of 260 nm using a spectral photometer (DU 640B, Beckman Coulter GmbH, Unterschleißheim, Germany). Double stranded RNA was generated by mixing an equimolar solution of complementary strands in annealing buffer (20 mM sodium phosphate, pH 6.8; 100 mM sodium chloride), heated in a water bath at 85-90° C. for 3 minutes and cooled to room temperature over a period of 3-4 hours. The annealed RNA solution was stored at −20° C. until use.

Conjugates

The following is a prophetic description of the synthesis of 3'-cholesterol-conjugated siRNAs (herein referred to as -Chol-3'), an appropriately modified solid support was used for RNA synthesis. The modified solid support was prepared as follows:

Diethyl-2-azabutane-1,4-dicarboxylate AA

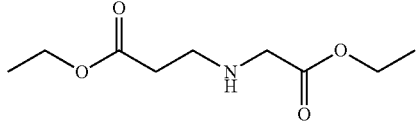

AA

A 4.7 M aqueous solution of sodium hydroxide (50 mL) was added into a stirred, ice-cooled solution of ethyl glycinate hydrochloride (32.19 g, 0.23 mole) in water (50 mL). Then, ethyl acrylate (23.1 g, 0.23 mole) was added and the mixture was stirred at room temperature until completion of the reaction was ascertained by TLC. After 19 h the solution was partitioned with dichloromethane (3×100 mL). The organic layer was dried with anhydrous sodium sulfate, filtered and evaporated. The residue was distilled to afford AA (28.8 g, 61%).

3-{Ethoxycarbonylmethyl-[6-(9H-fluoren-9-yl-methoxycarbonyl-amino)-hexanoyl]-amino}-propionic acid ethyl ester AB

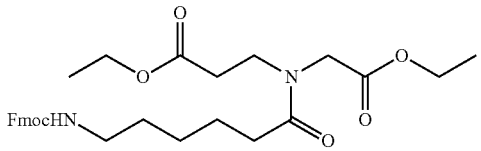

AB

Fmoc-6-amino-hexanoic acid (9.12 g, 25.83 mmol) was dissolved in dichloromethane (50 mL) and cooled with ice. Diisopropylcarbodiimde (3.25 g, 3.99 mL, 25.83 mmol) was added to the solution at 0° C. It was then followed by the addition of Diethyl-azabutane-1,4-dicarboxylate (5 g, 24.6 mmol) and dimethylamino pyridine (0.305 g, 2.5 mmol). The solution was brought to room temperature and stirred further for 6 h. Completion of the reaction was ascertained by TLC. The reaction mixture was concentrated under vacuum and ethyl acetate was added to precipitate diisopropyl urea. The suspension was filtered. The filtrate was washed with 5% aqueous hydrochloric acid, 5% sodium bicarbonate and water. The combined organic layer was dried over sodium sulfate and concentrated to give the crude product which was purified by column chromatography (50% EtOAC/Hexanes) to yield 11.87 g (88%) of AB.

3-[(6-Amino-hexanoyl)-ethoxycarbonylmethyl-amino]-propionic acid ethyl ester AC

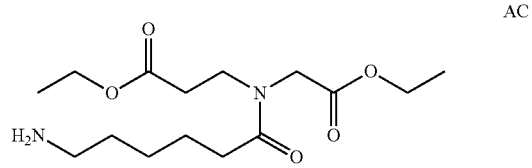 [SMILES: CCOC(=O)CCN(CC(=O)OCC)C(=O)CCCCCN]

AC

3-{Ethoxycarbonylmethyl-[6-(9H-fluoren-9-ylmethoxy-carbonylamino)-hexanoyl]-amino}-propionic acid ethyl ester AB (11.5 g, 21.3 mmol) was dissolved in 20% piperidine in dimethylformamide at 0° C. The solution was continued stirring for 1 h. The reaction mixture was concentrated under vacuum, water was added to the residue, and the product was extracted with ethyl acetate. The crude product was purified by conversion into its hydrochloride salt.

3-({6-[17-(1,5-Dimethyl-hexyl)-10,13-dimethyl-2,3,4,7,8,9,10,11,12,13,14,15,16,17-tetradecahydro-1H-cyclopenta[a]phenanthren-3-yloxycarbonylamino]-hexanoyl}ethoxycarbonylmethyl-amino)-propionic acid ethyl ester AD

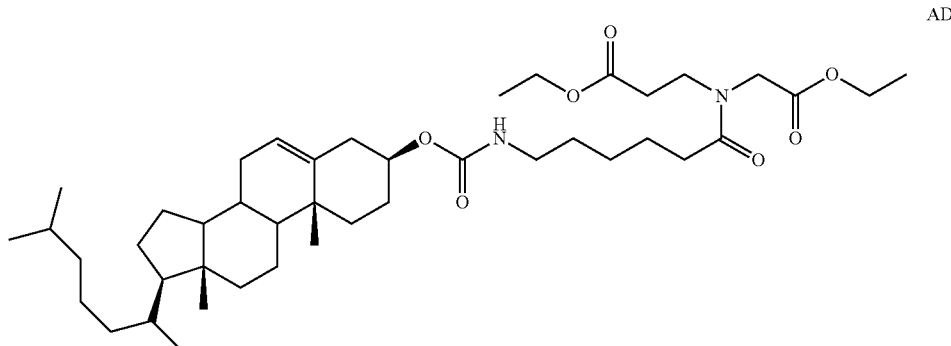

AD

The hydrochloride salt of 3-[(6-Amino-hexanoyl)-ethoxycarbonylmethyl-amino]-propionic acid ethyl ester AC (4.7 g, 14.8 mmol) was taken up in dichloromethane. The suspension was cooled to 0° C. on ice. To the suspension diisopropyl-ethylamine (3.87 g, 5.2 mL, 30 mmol) was added. To the resulting solution cholesteryl chloroformate (6.675 g, 14.8 mmol) was added. The reaction mixture was stirred overnight. The reaction mixture was diluted with dichloromethane and washed with 10% hydrochloric acid. The product was purified by flash chromatography (10.3 g, 92%).

1-{6-[17-(1,5-Dimethyl-hexyl)-10,13-dimethyl-2,3,
4,7,8,9,10,11,12,13,14,15,16,17-tetradecahydro-1H-
cyclopenta[a]phenanthren-3-yloxycarbonylamino]-
hexanoyl}-4-oxo-pyrrolidine-3-carboxylic acid ethyl
ester AE

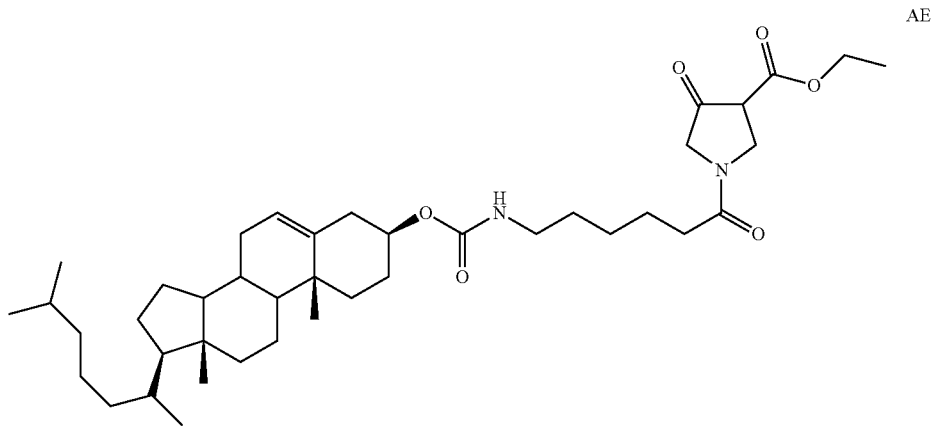 [SMILES: CCOC(=O)C1CN(C(=O)CCCCCNC(=O)O[C@H]2CC[C@@]3(C)C(=CCC4C3CC[C@@]3(C)C4CC[C@@H]3C(C)CCCC(C)C)C2)CC1=O]

Potassium t-butoxide (1.1 g, 9.8 mmol) was slurried in 30 mL of dry toluene. The mixture was cooled to 0° C. on ice and 5 g (6.6 mmol) of diester AD was added slowly with stirring within 20 mins. The temperature was kept below 5° C. during the addition. The stirring was continued for 30 mins at 0° C. and 1 mL of glacial acetic acid was added, immediately followed by 4 g of NaH$_2$PO$_4$.H$_2$O in 40 mL of water The resultant mixture was extracted twice with 100 mL of dichloromethane each and the combined organic extracts were washed twice with 10 mL of phosphate buffer each, dried, and evaporated to dryness. The residue was dissolved in 60 mL of toluene, cooled to 0° C. and extracted with three 50 mL portions of cold pH 9.5 carbonate buffer. The aqueous extracts were adjusted to pH 3 with phosphoric acid, and extracted with five 40 mL portions of chloroform which were combined, dried and evaporated to dryness. The residue was purified by column chromatography using 25% ethylacetate/hexane to afford 1.9 g of b-ketoester (39%).

[6-(3-Hydroxy-4-hydroxymethyl-pyrrolidin-1-yl)-6-
oxo-hexyl]-carbamic acid 17-(1,5-dimethyl-hexyl)-
10,13-dimethyl-2,3,4,7,8,9,10,11,12,13,14,15,16,17-
tetradecahydro-1H-cyclopenta[a]phenanthren-3-yl
ester AF

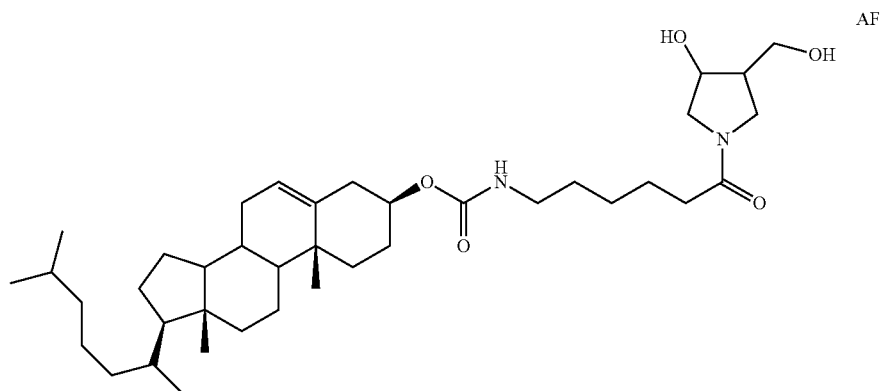 [SMILES: CC(C)CCCC(C)[C@H]1CCC2C3CC=C4C[C@@H](OC(=O)NCCCCCC(=O)N5CC(O)C(CO)C5)CC[C@]4(C)C3CC[C@@]21C]

Methanol (2 mL) was added dropwise over a period of 1 h to a refluxing mixture of b-ketoester AE (1.5 g, 2.2 mmol) and sodium borohydride (0.226 g, 6 mmol) in tetrahydrofuran (10 mL). Stirring was continued at reflux temperature for 1 h. After cooling to room temperature, 1 N HCl (12.5 mL) was added, the mixture was extracted with ethylacetate (3×40 mL). The combined ethylacetate layer was dried over anhydrous sodium sulfate and concentrated under vacuum to yield the product which was purified by column chromatography (10% MeOH/CHCl$_3$) (89%).

(6-{3-[Bis-(4-methoxy-phenyl)-phenyl-methoxymethyl]-4-hydroxy-pyrrolidin-1-yl}-6-oxo-hexyl)-carbamic acid 17-(1,5-dimethyl-hexyl)-10,13-dimethyl-2,3,4,7,8,9,10,11,12,13,14,15,16,17-tetradecahydro-1H-cyclopenta[a]phenanthren-3-yl ester AG

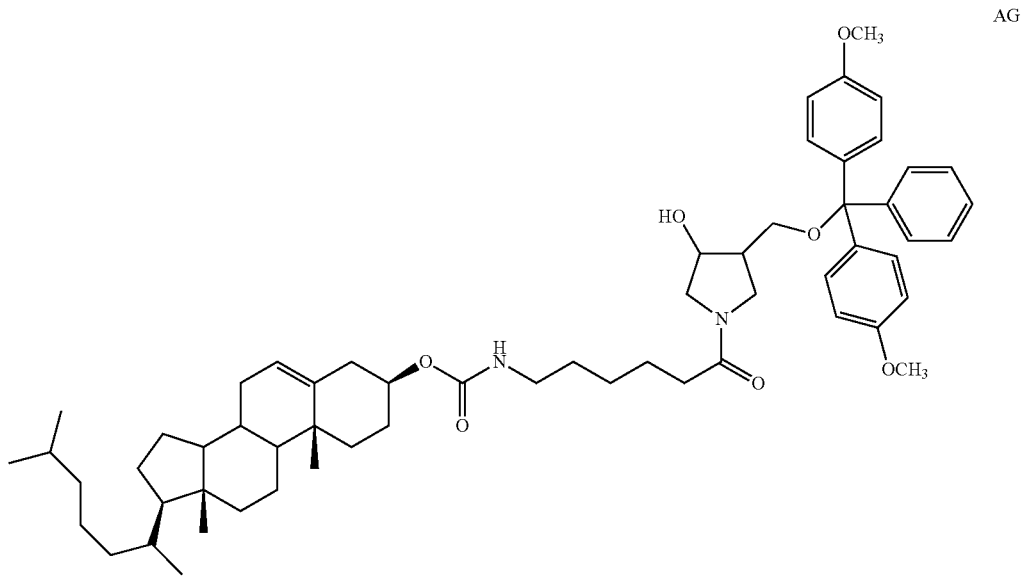 [SMILES: COc1ccc(C(OCC2CN(C(=O)CCCCCNC(=O)O[C@H]3CC[C@@]4(C)C(=CCC5C4CC[C@@]4(C)C5CC[C@@H]4C(C)CCCC(C)C)C3)CC2O)(c2ccccc2)c2ccc(OC)cc2)cc1]

Diol AF (1.25 gm 1.994 mmol) was dried by evaporating with pyridine (2×5 mL) in vacuo. Anhydrous pyridine (10 mL) and 4,4'-dimethoxytritylchloride (0.724 g, 2.13 mmol) were added with stirring. The reaction was carried out at room temperature overnight. The reaction was quenched by the addition of methanol. The reaction mixture was concentrated under vacuum and to the residue dichloromethane (50 mL) was added. The organic layer was washed with 1M aqueous sodium bicarbonate. The organic layer was dried over anhydrous sodium sulfate, filtered and concentrated. The residual pyridine was removed by evaporating with toluene. The crude product was purified by column chromatography (2% MeOH/Chloroform, Rf=0.5 in 5% MeOH/CHCl$_3$) (1.75 g, 95%).

Succinic acid mono-(4-[bis-(4-methoxy-phenyl)-phenyl-methoxymethyl]-1-{6-[17-(1,5-dimethylhexyl)-10,13-dimethyl 2,3,4,7,8,9,10,11,12,13,14,15,16,17-tetradecahydro-1H cyclopenta[a]phenanthren-3-yloxycarbonylamino]-hexanoyl}-pyrrolidin-3-yl) ester AH

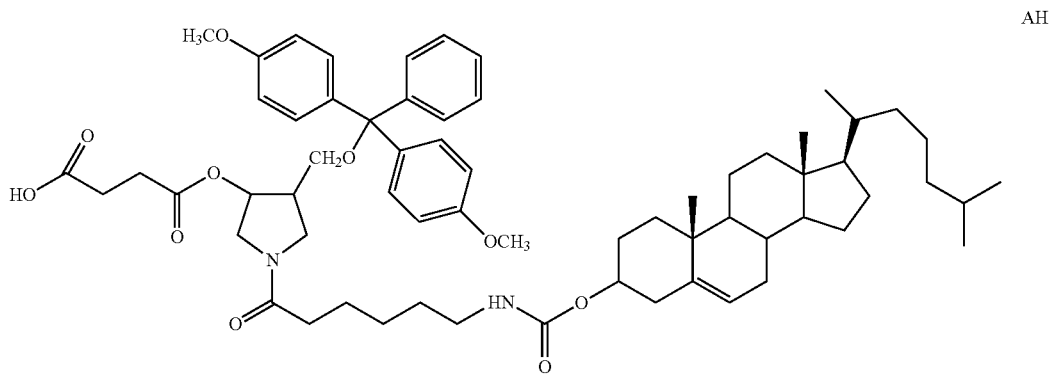

Compound AG (1.0 g, 1.05 mmol) was mixed with succinic anhydride (0.150 g, 1.5 mmol) and DMAP (0.073 g, 0.6 mmol) and dried in a vacuum at 40° C. overnight. The mixture was dissolved in anhydrous dichloroethane (3 mL), triethylamine (0.318 g, 0.440 mL, 3.15 mmol) was added and the solution was stirred at room temperature under argon atmosphere for 16 h. It was then diluted with dichloromethane (40 mL) and washed with ice cold aqueous citric acid (5 wt %, 30 mL) and water (2×20 mL). The organic phase was dried over anhydrous sodium sulfate and concentrated to dryness. The residue was used as such for the next step.

Cholesterol Derivatised CPG AI

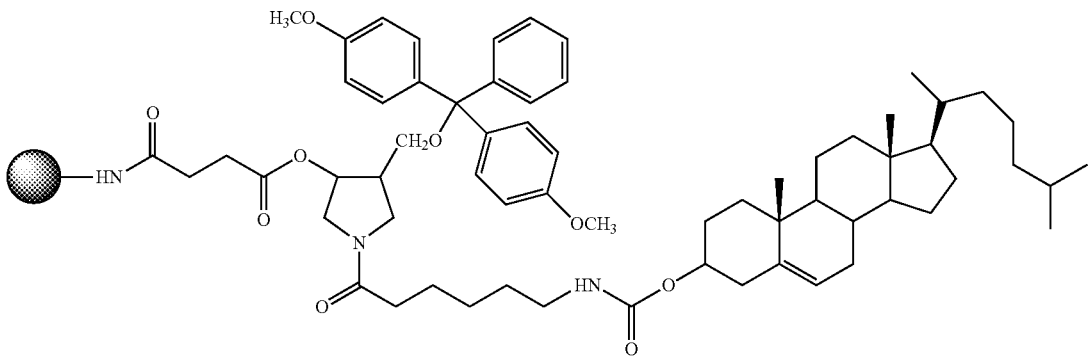

AI

Succinate AH (0.254 g, 0.242 mmol) was dissolved in a mixture of dichloromethane/acetonitrile (3:2, 3 mL). To that solution DMAP (0.0296 g, 0.242 mmol) in acetonitrile (1.25 mL), 2,2'-Dithio-bis(5-nitropyridine) (0.075 g, 0.242 mmol) in acetonitrile/dichloroethane (3:1, 1.25 mL) were added successively. To the resulting solution triphenylphosphine (0.064 g, 0.242 mmol) in acetonitrile (0.6 ml) was added. The reaction mixture turned bright orange in color. The solution was agitated briefly using a wrist-action shaker (5 mins). Long chain alkyl amine-CPG (LCAA-CPG) (1.5 g, 61 mM) was added. The suspension was agitated for 2 h. The CPG was filtered through a sintered funnel and washed with acetonitrile, dichloromethane and ether successively. Unreacted amino groups were masked using acetic anhydride/pyridine. The achieved loading of the CPG was measured by taking UV measurement (37 mM/g).

The synthesis of siRNAs bearing a 5'-12-dodecanoic acid bisdecylamide group (herein referred to as "5'-C32-") or a 5'-cholesteryl derivative group (herein referred to as "5'-Chol-") was performed as described in WO 2004/065601, except that, for the cholesteryl derivative, the oxidation step was performed using the Beaucage reagent in order to introduce a phosphorothioate linkage at the 5'-end of the nucleic acid oligomer.

dsRNA Targeting the Eg5 Gene

Initial Screening Set siRNA design was carried out to identify siRNAs targeting Eg5 (also known as KIF11, HSKP, KNSL1 and TRIP5). Human mRNA sequences to Eg5, RefSeq ID number:NM_004523, was used.

siRNA duplexes cross-reactive to human and mouse Eg5 were designed. Twenty-four duplexes were synthesized for screening. (Table 1a). A second screening set was defined with 266 siRNAs targeting human Eg5, as well as its rhesus monkey ortholog (Table 2a). An expanded screening set was selected with 328 siRNA targeting human Eg5, with no necessity to hit any Eg5 mRNA of other species (Table 3a).

The sequences for human and a partial rhesus Eg5 mRNAs were downloaded from NCBI Nucleotide database and the human sequence was further on used as reference sequence (Human EG5:NM_004523.2, 4908 bp, and Rhesus EG5: XM_001087644.1, 878 bp (only 5' part of human EG5)

For the Tables: Key: A,G,C,U-ribonucleotides: T-deoxythymidine: u,c-2'-O-methyl nucleotides: s-phosphorothioate linkage.

TABLE 1a

Sequences of Eg5/KSP dsRNA duplexes

| position in human Eg5/KSP sequence | SEQ ID NO: | sequence of 23mer target site | SEQ ID NO: | sense sequence (5'-3') | SEQ ID No: | antisense sequence (5'-3') | duplex name |
|---|---|---|---|---|---|---|---|
| 385-407 | 1244 | ACCGAAGUGUUGUUUGUCCAAUU | 1 | cGAAGuGuuGuuuGuccAATsT | 2 | UUGGAcAAAcAAcACUUCGTsT | AL-DP-6226 |
| 347-369 | 1245 | UAUGGUGUUUGGAGCAUCVACUA | 3 | uGGuGuuuGGAGcAucuAcTsT | 4 | GuAGAUGCUCcAAAcACcATsT | AL-DP-6227 |
| 1078-1100 | 1246 | AAUCUAAACUAACUAGAAUCCUC | 5 | ucuAAAcuAAcuAGAAucCTsT | 6 | GGAUUCuAGUuAGUUuAGATsT | AL-DP-6228 |
| 1067-1089 | 1247 | UCCUUAUCGAGAAUCUAAACUAA | 7 | cuuAucGAGAAucuAAAcuTsT | 8 | AGUUuAGAUUCUCGAuAAGTsT | AL-DP-6229 |
| 374-396 | 1248 | GAUUGAUGUUUACCGAAGUGUUG | 9 | uuGAuGuuuAccGAAGuGuTsT | 10 | AcACUUCGGuAAAcAUcAATsT | AL-DP-6230 |
| 205-227 | 1249 | UGGUGAGAUGCAGACCAUUUAAU | 11 | GuGAGAuGcAGAccAuuuATsT | 12 | uAAAUGGUCUGcAUCUcACTsT | AL-DP-6231 |
| 1176-1198 | 1250 | ACUCUGAGUACAUUGGAAUAUGC | 13 | ucuGAGuAcAuuGGAAuAuTsT | 14 | AuAUUCcAAUGuACUcAGATsT | AL-DP-6232 |
| 386-408 | 1251 | CCGAAGUGUUGUUUGUCCAAUUC | 15 | GAAGuGuuGuuuGuccAAuTsT | 16 | AUUGGAcAAAcAAcACUUCTsT | AL-DP-6233 |
| 416-438 | 1252 | AGUUAUUAUGGGCUAUAAUUGCA | 17 | uuAuuAuGGGcuAuAAuuGTsT | 18 | cAAUuAuAGCCcAuAAuAATsT | AL-DP-6234 |
| 485-507 | 1253 | GGAAGGUGAAAGGUCACCUAAUG | 19 | AAGGuGAAAGGucAccuAATsT | 20 | UuAGGUGACCUUUcACCUUTsT | AL-DP-6235 |
| 476-498 | 1254 | UUUUACAAUGGAAGGUGAAAGGU | 21 | uuAcAAuGGAAGGuGAAAGTsT | 22 | CUUUcACCUUCcAUUGuAATsT | AL-DP-6236 |
| 486-508 | 1255 | GAAGGUGAAAGGUCACCUAAUGA | 23 | AGGuGAAAGGucAccuAAuTsT | 24 | AUuAGGUGACCUUUcACCUTsT | AL-DP-6237 |
| 487-509 | 1256 | AAGGUGAAAGGUCACCUAAUGAA | 25 | GGuGAAAGGucAccuAAuGTsT | 26 | cAUuAGGUGACCUUUcACCTsT | AL-DP-6238 |
| 1066-1088 | 1257 | UUCCUUAUCGAGAAUCUAAACUA | 27 | ccuuAucGAGAAucuAAACTsT | 28 | GUuuAGAUUCUCGAuAAGGTsT | AL-DP-6239 |
| 1256-1278 | 1258 | AGCUCUUAUUAAGGAGUAUACGG | 29 | cucuuAuuAAGGAGuAuACTsT | 30 | GuAuACUCCUuAAuAAGAGTsT | AL-DP-6240 |
| 2329-2351 | 1259 | CAGAGAGAUUCUGUGCUUUGGAG | 31 | GAGAGAuucuGuGcuuuGGTsT | 32 | CcAAAGcAcAGAAUCUCUCTsT | AL-DP-6241 |
| 1077-1099 | 1260 | GAAUCUAAACUAACUAGAAUCCU | 33 | AucuAAAcuAAcuAGAAuCTsT | 34 | GAUUCuAGUuAGUUuAGAUTsT | AL-DP-6242 |
| 1244-1266 | 1261 | ACUCACCAAAAAGCUCUUAUUA | 35 | ucAccAAAAAGcucuuAuTsT | 36 | AuAAGAGCUUUUUGGUGATsT | AL-DP-6243 |
| 637-659 | 1262 | AAGAGCUUUUUGAUCUUCUUAAU | 37 | GAGcuuuuGAucuucuuATsT | 38 | uAAGAAGAUcAAAAAGCUCTsT | AL-DP-6244 |
| 1117-1139 | 1263 | GGCGUACAAGAACAUCUAUAAUU | 39 | cGuAcAAGAAcAucuAuAATsT | 40 | UuAuAGAUGUUCUUGuACGTsT | AL-DP-6245 |
| 373-395 | 1264 | AGAUUGAUGUUUACCGAAGUGUU | 41 | AuuGAuGuuuAccGAAGuGTsT | 42 | cACUUCGGuAAAcAUcAAUTsT | AL-DP-6246 |
| 1079-1101 | 1265 | AUCUAAACUAACUAGAAUCCUCC | | cuAAAcuAAcuAGAAuccuTsT | 44 | AGGAUUCuAGUuAGUUuAGTsT | AL-DP-6247 |
| 383-405 | 1266 | UUACCGAAGUGUUGUUUGUCCAA | 45 | AccGAAGuGuuGuuuGucCTsT | 46 | GGAcAAAcAAcACUUCGGUTsT | AL-DP-6248 |
| 200-222 | 1267 | GGUGGUGGUGAGAUGCAGACCAU | 47 | uGGuGGuGAGAuGcAGAcCTsT | 48 | GGUCUGcAUCUcACcACcATsT | AL-DP-6249 |

TABLE 1b

Analysis of Eg5/KSP ds duplexes

| duplex name | single dose screen @ 25 nM [% residual mRNA] | SDs 2nd screen (among quadruplicates) |
|---|---|---|
| AL-DP-6226 | 23% | 3% |
| AL-DP-6227 | 69% | 10% |
| AL-DP-6228 | 33% | 2% |
| AL-DP-6229 | 2% | 2% |
| AL-DP-6230 | 66% | 11% |
| AL-DP-6231 | 17% | 1% |
| AL-DP-6232 | 9% | 3% |
| AL-DP-6233 | 24% | 6% |
| AL-DP-6234 | 91% | 2% |
| AL-DP-6235 | 112% | 4% |
| AL-DP-6236 | 69% | 4% |
| AL-DP-6237 | 42% | 2% |
| AL-DP-6238 | 45% | 2% |
| AL-DP-6239 | 2% | 1% |
| AL-DP-6240 | 48% | 2% |
| AL-DP-6241 | 41% | 2% |
| AL-DP-6242 | 8% | 2% |
| AL-DP-6243 | 7% | 1% |
| AL-DP-6244 | 6% | 2% |
| AL-DP-6245 | 12% | 2% |
| AL-DP-6246 | 28% | 3% |
| AL-DP-6247 | 71% | 4% |
| AL-DP-6248 | 5% | 2% |
| AL-DP-6249 | 28% | 3% |

TABLE 2a

Sequences of Eg5/ KSP dsRNA duplexes

| SEQ ID NO: | sequence of 19-mer target site | SEQ ID NO. | sense sequence (5'-3') | SEQ ID NO. | antisense sequence (5'-3') | duplex name |
|---|---|---|---|---|---|---|
| 1268 | CAUACUCUAGUCGUUCCCA | 49 | cAuAcucuAGucGuucccATsT | 50 | UGGGAACGACuAGAGuAUGTsT | AD-12072 |
| 1269 | AGCGCCCAUUCAAUAGUAG | 51 | AGcGcccAuucAAuAGuAGTsT | 52 | CuACuAUUGAAUGGGCGCUTsT | AD-12073 |
| 1270 | GGAAAGCUAGCGCCCAUUC | 53 | GGAAAGcuAGcGcccAuucTsT | 54 | GAAUGGGCGCuAGCUUUCCTsT | AD-12074 |
| 1271 | GAAAGCUAGCGCCCAUUCA | 55 | GAAAGcuAGcGcccAuucATsT | 56 | UGAAUGGGCGCuAGCUUUCTsT | AD-12075 |
| 1272 | AGAAACUACGAUUGAUGGA | 57 | AGAAAcuAcGAuuGAuGGATsT | 58 | UCcAUcAAUCGuAGUUUCUTsT | AD-12076 |
| 1273 | UGUUCCUUAUCGAGAAUCU | 59 | uGuuccuuAucGAGAAucuTsT | 60 | AGAUUCUCGAuAAGGAAcATsT | AD-12077 |
| 1274 | CAGAUUACCUCUGCGAGCC | 61 | cAGAuuAccucuGcGAGccTsT | 62 | GGCUCGcAGAGGuAAUCUGTsT | AD-12078 |
| 1275 | GCGCCCAUUCAAUAGUAGA | 63 | GcGcccAuucAAuAGuAGATsT | 64 | UCuAcuAUUGAAUGGGCGCTsT | AD-12079 |
| 1276 | UUGCACUAUCUUUGCGUAU | 65 | uuGcAcuAucuuuGcGuAuTsT | 66 | AuACGcAAAGAuAGUGcAATsT | AD-12080 |
| 1277 | CAGAGCGGAAAGCUAGCGC | 67 | cAGAGcGGAAAGcuAGcGcTsT | 68 | GCGCuAGCUUUCCGCUCUGTsT | AD-12081 |
| 1278 | AGACCUUAUUUGGUAAUCU | 69 | AGAccuuAuuuGGuAAucuTsT | 70 | AGAUuACcAAAuAAGGUCUTsT | AD-12082 |
| 1279 | AUUCUCUUGGAGGGCGUAC | 71 | AuucucuuGGAGGGcGuAcTsT | 72 | GuACGCCCUCcAAGAGAAUTsT | AD-12083 |
| 1280 | GGCUGGUAUAAUUCCACGU | 73 | GGcuGGuAuAAuuccAcGuTsT | 74 | ACGUGGAAUuAuACcAGCCTsT | AD-12084 |
| 1281 | GCGGAAAGCUAGCGCCCAU | 75 | GcGGAAAGcuAGcGcccAuTsT | 76 | AUGGGCGCuAGCUUUCCGCTsT | AD-12085 |
| 1282 | UGCACUAUCUUUGCGUAUG | 77 | uGcAcuAucuuuGcGuAuGTsT | 78 | cAuACGcAAAGAuAGUGcATsT | AD-12086 |
| 1283 | GUAUAAUUCCACGUACCCU | 79 | GuAuAAuuccAcGuAcccuTsT | 80 | AGGGuACGUGGAAUuAuACTsT | AD-12087 |
| 1284 | AGAAUCUAAACUAACUAGA | 81 | AGAAucuAAAcuAAcuAGATsT | 82 | UCuAGUuAGUUuAGAUUCUTsT | AD-12088 |
| 1285 | AGGAGCUGAAUAGGGUUAC | 83 | AGGAGcuGAAuAGGGuuAcTsT | 84 | GuAACCCuAUUcAGCUCCUTsT | AD-12089 |
| 1286 | GAAGUACAUAAGACCUUAU | 85 | GAAGuAcAuAAGAccuuAuTsT | 86 | AuAAGGUCUuAUGuACUUCTsT | AD-12090 |
| 1287 | GACAGUGGCCGAUAAGAUA | 87 | GAcAGuGGccGAuAAGAuATsT | 88 | uAUCUuAUCGGcCACUGUCTsT | AD-12091 |
| 1288 | AAACCACUUAGUAGUGUCC | 89 | AAAccAcuuAGuAGuGuccTsT | 90 | GGAcACuACuAAGUGGUUUTsT | AD-12092 |
| 1289 | UCCCUAGACUUCCCUAUUU | 91 | ucccuAGAcuucccuAuuuTsT | 92 | AAAuAGGGAAGUCuAGGGATsT | AD-12093 |
| 1290 | UAGACUUCCCUAUUUCGCU | 93 | uAGAcuucccuAuuucGcuTsT | 94 | AGCGAAAuAGGGAAGUCuATsT | AD-12094 |
| 1291 | GCGUCGCAGCCAAAUUCGU | 95 | GcGucGcAGccAAAuucGuTsT | 96 | ACGAAUUUGGCUGCGACGCTsT | AD-12095 |

TABLE 2a-continued

Sequences of Eq5/ KSP dsRNA duplexes

| SEQ ID NO: | sequence of 19-mer target site | SEQ ID NO. | sense sequence (5'-3') | SEQ ID NO. | antisense sequence (5'-3') | duplex name |
|---|---|---|---|---|---|---|
| 1292 | AGCUAGCGCCCAUUCAAUA | 97 | AGcuAGcGcccAuucAAuATsT | 98 | uAUUGAAUGGGCGCuAGCUTsT | AD-12096 |
| 1293 | GAAACUACGAUUGAUGGAG | 99 | GAAAcuAcGAuuGAuGGAGTsT | 100 | CUCcAUcAAUCGuAGUUUCTsT | AD-12097 |
| 1294 | CCGAUAAGAUAGAAGAUCA | 101 | ccGAuAAGAuAGAAGAucATsT | 102 | UGAUCUUcUAUCUuAUCGGTsT | AD-12098 |
| 1295 | UAGCGCCCAUUCAAUAGUA | 103 | uAGcGcccAuucAAuAGuATsT | 104 | uACuAUUGAAUGGGCGCuATsT | AD-12099 |
| 1296 | UUUGCGUAUGGCCAAACUG | 105 | uuuGcGuAuGGccAAAcuGTsT | 106 | cAGUUUGGCcAuACGcAAATsT | AD-12100 |
| 1297 | CACGUACCCUUCAUCAAAU | 107 | cAcGuAcccuucAucAAAuTsT | 108 | AUUUGAUGAAGGGuACGUGTsT | AD-12101 |
| 1298 | UCUUUGCGUAUGGCCAAAC | 109 | ucuuuGcGuAuGGccAAAcTsT | 110 | GUUUGGCcAuACGcAAAGATsT | AD-12102 |
| 1299 | CCGAAGUGUUGUUUGUCCA | 111 | ccGAAGuGuuGuuuGuccATsT | 112 | UGGAcAAAcAAcACUUCGGTsT | AD-12103 |
| 1300 | AGAGCGGAAAGCUAGCGCC | 113 | AGAGcGGAAAGcuAGcGccTsT | 114 | GGCGCuAGCUUUCCGCUCUTsT | AD-12104 |
| 1301 | GCUAGCGCCCAUUCAAUAG | 115 | GcuAGcGcccAuucAAuAGTsT | 116 | CuAUUGAAUGGGCGCuAGCTsT | AD-12105 |
| 1302 | AAGUUAGUGUACGAACUGG | 117 | AAGuuAGuGuAcGAAcuGGTsT | 118 | CcAGUUCGuAcACuAACUUTsT | AD-12106 |
| 1303 | GUACGAACUGGAGGAUUGG | 119 | GuAcGAAcuGGAGGAuuGGTsT | 120 | CcAAUCCUCcAGUUCGuACTsT | AD-12107 |
| 1304 | ACGAACUGGAGGAUUGGCU | 121 | AcGAAcuGGAGGAuuGGcuTsT | 122 | AGCcAAUCCUCcAGUUCGUTsT | AD-12108 |
| 1305 | AGAUUGAUGUUUACCGAAG | 123 | AGAuuGAuGuuuAccGAAGTsT | 124 | CUUCGGuAAAcAUcAAUCUTsT | AD-12109 |
| 1306 | UAUGGGCUAUAAUUGCACU | 125 | uAuGGGcuAuAAuuGcAcuTsT | 126 | AGUGcAAUuAuAGCCcAuATsT | AD-12110 |
| 1307 | AUCUUUGCGUAUGGCCAAA | 127 | AucuuuGcGuAuGGccAAATsT | 128 | UUUGGCcAuACGcAAAGAUTsT | AD-12111 |
| 1308 | ACUCUAGUCGUUCCCACUC | 129 | AcucuAGucGuucccAcucTsT | 130 | GAGUGGGAACGACuAGAGUTsT | AD-12112 |
| 1309 | AACUACGAUUGAUGGAGAA | 131 | AAcuAcGAuuGAuGGAGAATsT | 132 | UUCUCcAUcAAUCGuAGUUTsT | AD-12113 |
| 1310 | GAUAAGAGAGCUCGGGAAG | 133 | GAuAAGAGAGcucGGGAAGTsT | 134 | CUUCCCGAGCUCUCUuAUCTsT | AD-12114 |
| 1311 | UCGAGAAUCUAAACUAACU | 135 | ucGAGAAucuAAAcuAAcuTsT | 136 | AGUuAGUUuAGAUUCUCGATsT | AD-12115 |
| 1312 | AACUAACUAGAAUCCUCCA | 137 | AAcuAAcuAGAAuccuccATsT | 138 | UGGAGGAUUCuAGUuAGUUTsT | AD-12116 |
| 1313 | GGAUCGUAAGAAGGCAGUU | 139 | GGAucGuAAGAAGGcAGuuTsT | 140 | AACUGCCUUCUuACGAUCCTsT | AD-12117 |
| 1314 | AUCGUAAGAAGGCAGUUGA | 141 | AucGuAAGAAGGcAGuuGATsT | 142 | UcAACUGCCUUCUuACGAUTsT | AD-12118 |
| 1315 | AGGCAGUUGACCAACACAA | 143 | AGGcAGuuGAccAAcAcAATsT | 144 | UUGUGUUGGUcAACUGCCUTsT | AD-12119 |
| 1316 | UGGCCGAUAAGAUAGAAGA | 145 | uGGccGAuAAGAuAGAAGATsT | 146 | UCUUCuAUCUuAUCGGccATsT | AD-12120 |
| 1317 | UCUAAGGAUAUAGUCAACA | 147 | ucuAAGGAuAuAGucAAcATsT | 148 | UGUUGAcuAuAUCCUuAGATsT | AD-12121 |
| 1318 | ACUAAGCUUAAUUGCUUUC | 149 | AcuAAGcuuAAuuGcuuucTsT | 150 | GAAAGcAAUuAAGCUuAGUTsT | AD-12122 |
| 1319 | GCCCAGAUCAACCUUUAAU | 151 | GcccAGAucAAccuuuAAuTsT | 152 | AUuAAAGGUUGAUCUGGGCTsT | AD-12123 |
| 1320 | UUAAUUGGCAGAGCGGAA | 153 | uuAAuuGGcAGAGcGGAATsT | 154 | UUCCGCUCUGCcAAAUuAATsT | AD-12124 |
| 1321 | UUAUCGAGAAUCUAAACUA | 155 | uuAucGAGAAucuAAAcuATsT | 156 | uAGUUuAGAUUCUCGAuAATsT | AD-12125 |
| 1322 | CUAGCGCCCAUUCAAUAGU | 157 | cuAGcGcccAuucAAuAGuTsT | 158 | ACuAUUGAAUGGGCGCuAGTsT | AD-12126 |
| 1323 | AAUAGUAGAAUGUGAUCCU | 159 | AAuAGuAGAAuGuGAuccuTsT | 160 | AGGAUcAcAUUCuAcuAUUTsT | AD-12127 |
| 1324 | UACGAAAAGAAGUUAGUGU | 161 | uAcGAAAAGAAGuuAGuGuTsT | 162 | AcACuAACUUCUUUUCGuATsT | AD-12128 |
| 1325 | AGAAGUUAGUGUACGAACU | 163 | AGAAGuuAGuGuAcGAAcuTsT | 164 | AGUUCGuAcACuAACUUCUTsT | AD-12129 |
| 1326 | ACUAAACAGAUUGAUGUUU | 165 | AcuAAAcAGAuuGAuGuuuTsT | 166 | AAAcAUcAAUCUGUUuAGUTsT | AD-12130 |
| 1327 | CUUUGCGUAUGGCCAAACU | 167 | cuuuGcGuAuGGccAAAcuTsT | 168 | AGUUUGGCcAuACGcAAAGTsT | AD-12131 |
| 1328 | AAUGAAGAGUAUACCUGGG | 169 | AAuGAAGAGuAuAccuGGGTsT | 170 | CCcAGGuAuACUCUUcAUUTsT | AD-12132 |

TABLE 2a-continued

Sequences of Eq5/ KSP dsRNA duplexes

| SEQ ID NO: | sequence of 19-mer target site | SEQ ID NO. | sense sequence (5'-3') | SEQ ID NO. | antisense sequence (5'-3') | duplex name |
|---|---|---|---|---|---|---|
| 1329 | AUAAUUCCACGUACCCUUC | 171 | AuAAuccAcGuAcccuucTsT | 172 | GAAGGGuACGUGGAAUuAUTsT | AD-12133 |
| 1330 | ACGUACCCUUCAUCAAAUU | 173 | AcGuAcccuucAucAAAuuTsT | 174 | AAUUUGAUGAAGGGuACGUTsT | AD-12134 |
| 1331 | CGUACCCUUCAUCAAAUUU | 175 | cGuAcccuucAucAAAuuuTsT | 176 | AAAUUUGAUGAAGGGuACGTsT | AD-12135 |
| 1332 | GUACCCUUCAUCAAAUUUU | 177 | GuAcccuucAucAAAuuuuTsT | 178 | AAAAUUUGAUGAAGGGuACTsT | AD-12136 |
| 1333 | AACUUACUGAUAAUGGUAC | 179 | AAcuuAcuGAuAAuGGuAcTsT | 180 | GuACcAUuAUcAGuAAGUUTsT | AD-12137 |
| 1334 | UUCAGUCAAAGUGUCUCUG | 181 | uucAGucAAAGuGucucuGTsT | 182 | cAGAGAcACUUUGACUGAATsT | AD-12138 |
| 1335 | UUCUUAAUCCAUCAUCUGA | 183 | uucuuAAuccAucAucuGATsT | 184 | UcAGAUGAUGGAUuAAGAATsT | AD-12139 |
| 1336 | ACAGUACACAACAAGGAUG | 185 | AcAGuAcAcAAcAAGGAuGTsT | 186 | cAUCCUUGUUGUGuACUGUTsT | AD-12140 |
| 1337 | AAGAAACUACGAUUGAUGG | 187 | AAGAAAcuAcGAuuGAuGGTsT | 188 | CcAUcAAUCGuAGUUUCUUTsT | AD-12141 |
| 1338 | AAACUACGAUUGAUGGAGA | 189 | AAAcuAcGAuuGAuGGAGATsT | 190 | UCUCcAUcAAUCGuAGUUUTsT | AD-12142 |
| 1339 | UGGAGCUGUUGAUAAGAGA | 191 | uGGAGcuGuuGAuAAGAGATsT | 192 | UCUCUuAUcAAcAGCUCcATsT | AD-12143 |
| 1340 | CUAACUAGAAUCCUCCAGG | 193 | cuAAcuAGAAuccuccAGGTsT | 194 | CCUGGAGGAUUCuAGUuAGTsT | AD-12144 |
| 1341 | GAAUAUGCUCAUAGAGCAA | 195 | GAAuAuGcucAuAGAGcAATsT | 196 | UUGCUCuAUGAGcAuAUUCTsT | AD-12145 |
| 1342 | AUGCUCAUAGAGCAAAGAA | 197 | AuGcucAuAGAGcAAAGAATsT | 198 | UUCUUUGCUCuAUGAGcAUTsT | AD-12146 |
| 1343 | AAAAAUUGGUGCUGUUGAG | 199 | AAAAAuuGGuGcuGuuGAGTsT | 200 | CUcAAcAGcAccAAUUUUUTsT | AD-12147 |
| 1344 | GAGGAGCUGAAUAGGGUUA | 201 | GAGGAGcuGAAuAGGGuuATsT | 202 | uAACCCuAUUcAGCUCCUCTsT | AD-12148 |
| 1345 | GGAGCUGAAUAGGGUUACA | 203 | GGAGcuGAAuAGGGuuAcATsT | 204 | UGuAACCCuAUUcAGCUCCTsT | AD-12149 |
| 1346 | GAGCUGAAUAGGGUUACAG | 205 | GAGcuGAAuAGGGuuAcAGTsT | 206 | CUGuAACCCuAUUcAGCUCTsT | AD-12150 |
| 1347 | AGCUGAAUAGGGUUACAGA | 207 | AGcuGAAuAGGGuuAcAGATsT | 208 | UCUGuAACCCuAUUcAGCUTsT | AD-12151 |
| 1348 | GCUGAAUAGGGUUACAGAG | 209 | GcuGAAuAGGGuuAcAGAGTsT | 210 | CUCUGuAACCCuAUUcAGCTsT | AD-12152 |
| 1349 | CCAAACUGGAUCGUAAGAA | 211 | ccAAAcuGGAucGuAAGAATsT | 212 | UUCUuACGAUCcAGUUUGGTsT | AD-12153 |
| 1350 | GAUCGUAAGAAGGCAGUUG | 213 | GAucGuAAGAAGGcAGuuGTsT | 214 | cAACUGCCUUCUuACGAUCTsT | AD-12154 |
| 1351 | ACCUUAUUUGGUAAUCUGC | 215 | AccuuAuuuGGuAAucuGcTsT | 216 | GcAGAUuACcAAAuAAGGUTsT | AD-12155 |
| 1352 | UUAGAUACCAUUACUACAG | 217 | uuAGAuAccAuuAcuAcAGTsT | 218 | CUGuAGuAAUGGuAUCuAATsT | AD-12156 |
| 1353 | AUACCAUUACUACAGUAGC | 219 | AuAccAuuAcuAcAGuAGcTsT | 220 | GCuACUGuAGuAAUGGuAUTsT | AD-12157 |
| 1354 | UACUACAGUAGCACUUGGA | 221 | uAcuAcAGuAGcAcuuGGATsT | 222 | UCcAAGUGCuACUGuAGuATsT | AD-12158 |
| 1355 | AAAGUAAAACUGUACUACA | 223 | AAAGuAAAAcuGuAcuAcATsT | 224 | UGuAGuAcAGUUUuACUUUTsT | AD-12159 |
| 1356 | CUCAAGACUGAUCUUCUAA | 225 | cucAAGAcuGAucuucuAATsT | 226 | UuAGAAGAUcAGUCUUGAGTsT | AD-12160 |
| 1357 | UUGACAGUGGCCGAUAAGA | 227 | uuGAcAGuGGccGAuAAGATsT | 228 | UCUuAUCGGccACUGUcAATsT | AD-12161 |
| 1358 | UGACAGUGGCCGAUAAGAU | 229 | uGAcAGuGGccGAuAAGAuTsT | 230 | AUCUuAUCGGccACUGUcATsT | AD-12162 |
| 1359 | GCAAUGUGGAAACCUAACU | 231 | GcAAuGuGGAAAccuAAcuTsT | 232 | AGUuAGGUUUCcAcAUUGCTsT | AD-12163 |
| 1360 | CCACUUAGUAGUGUCCAGG | 233 | ccAcuuAGuAGuGuccAGGTsT | 234 | CCUGGAcACuAcuAAGUGGTsT | AD-12164 |
| 1361 | AGAAGGUACAAAAUUGGUU | 235 | AGAAGGuAcAAAAuuGGuuTsT | 236 | AAccAAUUUUGuACCUUCUTsT | AD-12165 |
| 1362 | UGGUUUGACUAAGCUUAAU | 237 | uGGuuuGAcuAAGcuuAAuTsT | 238 | AUuAAGCUuAGUcAAACcATsT | AD-12166 |
| 1363 | GGUUUGACUAAGCUUAAUU | 239 | GGuuuGAcuAAGcuuAAuuTsT | 240 | AAUuAAGCUuAGUcAAACCTsT | AD-12167 |
| 1364 | UCUAAGUCAAGAGCCAUCU | 241 | ucuAAGucAAGAGccAucuTsT | 242 | AGAUGGCUCUUGACUuAGATsT | AD-12168 |
| 1365 | UCAUCCCUAUAGUUCACUU | 243 | ucAucccuAuAGuucAcuuTsT | 244 | AAGUGAACuAuAGGGAUGATsT | AD-12169 |

TABLE 2a-continued

Sequences of Eg5/ KSP dsRNA duplexes

| SEQ ID NO: | sequence of 19-mer target site | SEQ ID NO. | sense sequence (5'-3') | SEQ ID NO. | antisense sequence (5'-3') | duplex name |
|---|---|---|---|---|---|---|
| 1366 | CAUCCCUAUAGUUCACUUU | 245 | cAucccuAuAGuucAcuuuTsT | 246 | AAAGUGAACuAuAGGGAUGTsT | AD-12170 |
| 1367 | CCCUAGACUUCCCUAUUUC | 247 | cccuAGAcuucccuAuuucTsT | 248 | GAAAuAGGGAAGUCuAGGGTsT | AD-12171 |
| 1368 | AGACUUCCCUAUUUCGCUU | 249 | AGAcuucccuAuuucGcuuTsT | 250 | AAGCGAAAuAGGGAAGUCUTsT | AD-12172 |
| 1369 | UCACCAAACCAUUUGUAGA | 251 | ucAccAAAccAuuuGuAGATsT | 252 | UCuAcAAAUGGUUUGGUGATsT | AD-12173 |
| 1370 | UCCUUUAAGAGGCCUAACU | 253 | uccuuuAAGAGGccuAAcuTsT | 254 | AGUuAGGCCUCUuAAAGGATsT | AD-12174 |
| 1371 | UUUAAGAGGCCUAACUCAU | 255 | uuuAAGAGGccuAAcucAuTsT | 256 | AUGAGUuAGGCCUCUuAAATsT | AD-12175 |
| 1372 | UUAAGAGGCCUAACUCAUU | 257 | uuAAGAGGccuAAcucAuuTsT | 258 | AAUGAGUuAGGCCUCUuAATsT | AD-12176 |
| 1373 | GGCCUAACUCAUUCACCCU | 259 | GGccuAAcucAuucAcccuTsT | 260 | AGGGUGAAUGAGUuAGGCCTsT | AD-12177 |
| 1374 | UGGUAUUUUGAUCUGGCA | 261 | uGGuAuuuuuGAucuGGcATsT | 262 | UGCcAGAUcAAAAAuACcATsT | AD-12178 |
| 1375 | AGUUUAGUGUGUAAAGUUU | 263 | AGuuuAGuGuGuAAAGuuuTsT | 264 | AAACUUuAcAcACuAAACUTsT | AD-12179 |
| 1376 | GCCAAAUUCGUCUGCGAAG | 265 | GccAAAuucGucuGcGAAGTsT | 266 | CUUCGcAGACGAAUUUGGCTsT | AD-12180 |
| 1377 | AAUUCGUCUGCGAAGAAGA | 267 | AAuucGucuGcGAAGAAGATsT | 268 | UCUUCUUCGcAGACGAAUUTsT | AD-12181 |
| 1378 | UGAAAGGUCACCUAAUGAA | 269 | uGAAAGGucAccuAAuGAATsT | 270 | UUcAUuAGGUGACCUUUcATsT | AD-12182 |
| 1379 | CAGACCAUUUAAUUUGGCA | 271 | cAGAccAuuuAAuuuGGcATsT | 272 | UGCcAAAUuAAAUGGUCUGTsT | AD-12183 |
| 1380 | AGACCAUUUAAUUUGGCAG | 273 | AGAccAuuuAAuuuGGcAGTsT | 274 | CUGCcAAAUuAAAUGGUCUTsT | AD-12184 |
| 1381 | AGUUAUUAUGGGCUAUAAU | 275 | AGuuAuuAuGGGcuAuAAuTsT | 276 | AUuAuAGCCcAuAAuAACUTsT | AD-12185 |
| 1382 | GCUGGUAUAAUUCCACGUA | 277 | GcuGGuAuAAuuccAcGuATsT | 278 | uACGUGGAAUuAuACcAGCTsT | AD-12186 |
| 1383 | AUUUAAUUUGGCAGAGCGG | 279 | AuuuAAuuuGGcAGAGcGGTsT | 280 | CCGCUCUGCcAAAUuAAAUTsT | AD-12187 |
| 1384 | UUUAAUUUGGCAGAGCGGA | 281 | uuuAAuuuGGcAGAGcGGATsT | 282 | UCCGCUCUGCcAAAUuAAATsT | AD-12188 |
| 1385 | UUUGGCAGAGCGGAAAGCU | 283 | uuuGGcAGAGcGGAAAGcuTsT | 284 | AGCUUUCCGCUCUGCcAAATsT | AD-12189 |
| 1386 | UUUUACAAUGGAAGGUGAA | 285 | uuuuAcAAuGGAAGGuGAATsT | 286 | UUcACCUUCcAUUGuAAAATsT | AD-12190 |
| 1387 | AAUGGAAGGUGAAAGGUCA | 287 | AAuGGAAGGuGAAAGGucATsT | 288 | UGACCUUUcACCUUCcAUUTsT | AD-12191 |
| 1388 | UGAGAUGCAGACCAUUUAA | 289 | uGAGAuGcAGAccAuuuAATsT | 290 | UuAAAUGGUCUGcAUCUcATsT | AD-12192 |
| 1389 | UCGCAGCCAAAUUCGUCUG | 291 | ucGcAGccAAAuucGucuGTsT | 292 | cAGACGAAUUUGGCUGCGATsT | AD-12193 |
| 1390 | GGCUAUAAUUGCACUAUCU | 293 | GGcuAuAAuuGcAcuAucuTsT | 294 | AGAuAGUGcAAUuAuAGCCTsT | AD-12194 |
| 1391 | AUUGACAGUGGCCGAUAAG | 295 | AuuGAcAGuGGccGAuAAGTsT | 296 | CUuAUCGGCcACUGUcAAUTsT | AD-12195 |
| 1392 | CUAGACUUCCCUAUUUCGC | 297 | cuAGAcuucccuAuuucGcTsT | 298 | GCGAAAuAGGGAAGUCuAGTsT | AD-12196 |
| 1393 | ACUAUCUUUGCGUAUGGCC | 299 | AcuAucuuuGcGuAuGGccTsT | 300 | GGCcAuACGcAAAGAuAGUTsT | AD-12197 |
| 1394 | AUACUCUAGUCGUUCCCAC | 301 | AuAcucuAGucGuucccAcTsT | 302 | GUGGGAACGACuAGAGuAUTsT | AD-12198 |
| 1395 | AAAGAAACUACGAUUGAUG | 303 | AAAGAAAcuAcGAuuGAuGTsT | 304 | cAUcAAUCGuAGUUUCUUUTsT | AD-12199 |
| 1396 | GCCUUGAUUUUUGGCGGG | 305 | GccuuGAuuuuuGGcGGGTsT | 306 | CCCGCcAAAAAUcAAGGCTsT | AD-12200 |
| 1397 | CGCCCAUUCAAUAGUAGAA | 307 | cGcccAuucAAuAGuAGAATsT | 308 | UUCuAcuAUUGAAuGGGCGTsT | AD-12201 |
| 1398 | CCUUAUUUGGUAAUCUGCU | 309 | ccuuAuuuGGuAAucuGcuTsT | 310 | AGcAGAUuACcAAAuAAGGTsT | AD-12202 |
| 1399 | AGAGACAAUUCCGGAUGUG | 311 | AGAGAcAAuuccGGAuGuGTsT | 312 | cAcAUCCGGAAUUGUCUCUTsT | AD-12203 |
| 1400 | UGACUUUGAUAGCUAAAUU | 313 | uGAcuuuGAuAGcuAAAuuTsT | 314 | AAUUuAGCuAUcAAAGUcATsT | AD-12204 |
| 1401 | UGGCAGAGCGGAAAGCUAG | 315 | uGGcAGAGcGGAAAGcuAGTsT | 316 | CuAGCUUUCCGCUCUGCcATsT | AD-12205 |
| 1402 | GAGCGGAAAGCUAGCGCCC | 317 | GAGcGGAAAGcuAGcGcccTsT | 318 | GGGCGCuAGCUUUCCGCUCTsT | AD-12206 |

TABLE 2a-continued

Sequences of Eg5/ KSP dsRNA duplexes

| SEQ ID NO: | sequence of 19-mer target site | SEQ ID NO. | sense sequence (5'-3') | SEQ ID NO. | antisense sequence (5'-3') | duplex name |
|---|---|---|---|---|---|---|
| 1403 | AAAGAAGUUAGUGUACGAA | 319 | AAAGAAGuuAGuGuAcGAATsT | 320 | UUCGuAcACuAACUUCUUUTsT | AD-12207 |
| 1404 | AUUGCACUAUCUUUGCGUA | 321 | AuuGcAcuAucuuuGcGuATsT | 322 | uACGcAAAGAuAGUGcAAUTsT | AD-12208 |
| 1405 | GGUAUAAUUCCACGUACCC | 323 | GGuAuAAuuccAcGuAcccTsT | 324 | GGGuACGUGGAAUuAuACCTsT | AD-12209 |
| 1406 | UACUCUAGUCGUUCCCACU | 325 | uAcucuAGucGuucccAcuTsT | 326 | AGUGGGAACGACuAGAGuATsT | AD-12210 |
| 1407 | UAUGAAAGAAACUACGAUU | 327 | uAuGAAAGAAAcuAcGAuuTsT | 328 | AAUCGuAGUUUCUUUcAuATsT | AD-12211 |
| 1408 | AUGCUAGAAGUACAUAAGA | 329 | AuGcuAGAAGuAcAuAAGATsT | 330 | UCUuAUGuACUUCuAGcAUTsT | AD-12212 |
| 1409 | AAGUACAUAAGACCUUAUU | 331 | AAGuAcAuAAGAccuuAuuTsT | 332 | AAuAAGGUCUuAUGuACUUTsT | AD-12213 |
| 1410 | ACAGCCUGAGCUGUUAAUG | 333 | AcAGccuGAGcuGuuAAuGTsT | 334 | cAUuAAcAGCUcAGGCUGUTsT | AD-12214 |
| 1411 | AAAGAAGAGACAAUUCCGG | 335 | AAAGAAGAGAcAAuuccGGTsT | 336 | CCGGAAUUGUCUCUUCUUUTsT | AD-12215 |
| 1412 | CACACUGGAGAGGUCUAAA | 337 | cAcAcuGGAGAGGucuAAATsT | 338 | UUuAGACCUCUCcAGUGUGTsT | AD-12216 |
| 1413 | CACUGGAGAGGUCUAAAGU | 339 | cAcuGGAGAGGucuAAAGuTsT | 340 | ACUuAGACCUCUCcAGUGTsT | AD-12217 |
| 1414 | ACUGGAGAGGUCUAAAGUG | 341 | AcuGGAGAGGucuAAAGuGTsT | 342 | cACUuAGACCUCUCcAGUTsT | AD-12218 |
| 1415 | CGUCGCAGCCAAAUUCGUC | 343 | cGucGcAGccAAAuucGucTsT | 344 | GACGAAUUUGGCUGCGACGTsT | AD-12219 |
| 1416 | GAAGGCAGUUGACCAACAC | 345 | GAAGGcAGuuGAccAAcAcTsT | 346 | GUGUUGGUcAACUGCCUUCTsT | AD-12220 |
| 1417 | CAUUCACCCUGACAGAGUU | 347 | cAuucAcccuGAcAGAGuuTsT | 348 | AACUCUGUcAGGGUGAAUGTsT | AD-12221 |
| 1418 | AAGAGGCCUAACUCAUUCA | 349 | AAGAGGccuAAcucAuucATsT | 350 | UGAAUGAGUuAGGCCUCUUTsT | AD-12222 |
| 1419 | GAGACAAUUCCGGAUGUGG | 351 | GAGAcAAuuccGGAuGuGGTsT | 352 | CcAcAUCCGGAAUUGUCUCTsT | AD-12223 |
| 1420 | UUCCGGAUGUGGAUGUAGA | 353 | uuccGGAuGuGGAuGuAGATsT | 354 | UCuAcAUCcAcAUCCGGAATsT | AD-12224 |
| 1421 | AAGCUAGCGCCCAUUCAAU | 355 | AAGcuAGcGcccAuucAAuTsT | 356 | AUUGAAuGGGCGCuAGCUUTsT | AD-12225 |
| 1422 | GAAGUUAGUGUACGAACUG | 357 | GAAGuuAGuGuAcGAAcuGTsT | 358 | cAGUUCGuAcACuAACUUCTsT | AD-12226 |
| 1423 | UAUAAUUCCACGUACCCUU | 359 | uAuAAuuccAcGuAcccuuTsT | 360 | AAGGGuACGUGGAAUuAuATsT | AD-12227 |
| 1424 | ACAGUGGCCGAUAAGAUAG | 361 | AcAGuGGccGAuAAGAuAGTsT | 362 | CuAUCUuAUCGGCcACUGUTsT | AD-12228 |
| 1425 | UCUGUCAUCCCUAUAGUUC | 363 | ucuGucAucccuAuAGuucTsT | 364 | GAACuAuAGGGAuGAcAGATsT | AD-12229 |
| 1426 | UUCUUGCUAUGACUUGUGU | 365 | uucuuGcuAuGAcuuGuGuTsT | 366 | AcAcAAGUcAuAGcAAGAATsT | AD-12230 |
| 1427 | GUAAGAAGGCAGUUGACCA | 367 | GuAAGAAGGcAGuuGAccATsT | 368 | UGGUcAACUGCCUUCUuACTsT | AD-12231 |
| 1428 | CAUUGACAGUGGCCGAUAA | 369 | cAuuGAcAGuGGccGAuAATsT | 370 | UuAUCGGCcACUGUcAAUGTsT | AD-12232 |
| 1429 | AGAAACCACUUAGUAGUGU | 371 | AGAAAccAcuuAGuAGuGuTsT | 372 | AcACuACuAAGUGGUUUCUTsT | AD-12233 |
| 1430 | GGAUUGUUCAUCAAUUGGC | 373 | GGAuuGuucAucAAuuGGcTsT | 374 | GCcAAUUGAUGAAcAAUCCTsT | AD-12234 |
| 1431 | UAAGAGGCCUAACUCAUUC | 375 | uAAGAGGccuAAcucAuucTsT | 376 | GAAUGAGUuAGGCCUCUuATsT | AD-12235 |
| 1432 | AGUUAGUGUACGAACUGGA | 377 | AGuuAGuGuAcGAAcuGGATsT | 378 | UCcAGUUCGuAcACuAACUTsT | AD-12236 |
| 1433 | AGUACAUAAGACCUUAUUU | 379 | AGuAcAuAAGAccuuAuuuTsT | 380 | AAAuAAGGUCUuAUGuACUTsT | AD-12237 |
| 1434 | UGAGCCUUGUGUAUAGAUU | 381 | uGAGccuuGuGuAuAGAuuTsT | 382 | AAUCuAuAcAcAAGGCUcATsT | AD-12238 |
| 1435 | CCUUUAAGAGGCCUAACUC | 383 | ccuuuAAGAGGccuAAcucTsT | 384 | GAGUuAGGCCUCUuAAAGGTsT | AD-12239 |
| 1436 | ACCACUUAGUAGUGUCCAG | 385 | AccAcuuAGuAGuGuccAGTsT | 386 | CUGGAcACuACuAAGUGGUTsT | AD-12240 |
| 1437 | GAAACUUCCAAUUAUGCUC | 387 | GAAAcuccAAuuAuGcucTsT | 388 | AGAcAAAUUGGAAGUUUCTsT | AD-12241 |
| 1438 | UGCAUACUCUAGUCGUUCC | 389 | uGcAuAcucuAGucGuuccTsT | 390 | GGAACGACuAGAGuAUGcATsT | AD-12242 |
| 1439 | AGAAGGCAGUUGACCAACA | 391 | AGAAGGcAGuuGAccAAcATsT | 392 | UGUUGGUcAACUGCCUUCUTsT | AD-12243 |

TABLE 2a-continued

Sequences of Eq5/ KSP dsRNA duplexes

| SEQ ID NO: | sequence of 19-mer target site | SEQ ID NO. | sense sequence (5'-3') | SEQ ID NO. | antisense sequence (5'-3') | duplex name |
|---|---|---|---|---|---|---|
| 1440 | GUACAUAAGACCUUAUUUG | 393 | GuAcAuAAGAccuuAuuuGTsT | 394 | cAAAuAAGGUCUuAUGuACTsT | AD-12244 |
| 1441 | UAUAAUUGCACUAUCUUUG | 395 | uAuAAuuGcAcuAucuuuGTsT | 396 | cAAAGAuAGUGcAAUuAuATsT | AD-12245 |
| 1442 | UCUCUGUUACAAUACAUAU | 397 | ucucuGuuAcAAuAcAuAuTsT | 398 | AuAUGuAUUGuAAcAGAGATsT | AD-12246 |
| 1443 | UAUGCUCAUAGAGCAAAGA | 399 | uAuGcucAuAGAGcAAAGATsT | 400 | UCUUUGCUCuAUGAGcAuATsT | AD-12247 |
| 1444 | UGUUGUUUGUCCAAUUCUG | 401 | uGuuGuuuGuccAAuucuGTsT | 402 | cAGAAUUGGAcAAAcAAcATsT | AD-12248 |
| 1445 | ACUAACUAGAAUCCUCCAG | 403 | AcuAAcuAGAAuccuccAGTsT | 404 | CUGGAGGAUUCuAGUuAGUTsT | AD-12249 |
| 1446 | UGUGGUGUCUAUACUGAAA | 405 | uGuGGuGucuAuAcuGAAATsT | 406 | UUUcAGuAuAGAcACcAcATsT | AD-12250 |
| 1447 | UAUUAUGGGAGACCACCCA | 407 | uAuuAuGGGAGAccAcccATsT | 408 | UGGGUGGUCUCCcAuAAuATsT | AD-12251 |
| 1448 | AAGGAUGAAGUCUAUCAAA | 409 | AAGGAuGAAGucuAucAAATsT | 410 | UUUGAuAGACUUcAUCCUUTsT | AD-12252 |
| 1449 | UUGAUAAGAGAGCUCGGGA | 411 | uuGAuAAGAGAGcucGGGATsT | 412 | UCCCGAGCUCUCUuAUcAATsT | AD-12253 |
| 1450 | AUGUUCCUUAUCGAGAAUC | 413 | AuGuuccuuAucGAGAAucTsT | 414 | GAUUCUCGAuAAGGAAcAUTsT | AD-12254 |
| 1451 | GGAAUAUGCUCAUAGAGCA | 415 | GGAAuAuGcucAuAGAGcATsT | 416 | UGCUCuAUGAGcAuAUUCCTsT | AD-12255 |
| 1452 | CCAUUCCAAACUGGAUCGU | 417 | ccAuuccAAAcuGGAucGuTsT | 418 | ACGAUCcAGUUUGGAAUGGTsT | AD-12256 |
| 1453 | GGCAGUUGACCAACACAAU | 419 | GGcAGuuGAccAAcAcAAuTsT | 420 | AUUGUGUUGGUcAACUGCCTsT | AD-12257 |
| 1454 | CAUGCUAGAAGUACAUAAG | 421 | cAuGcuAGAAGuAcAuAAGTsT | 422 | CUuAUGuACUUcuAGcAUGTsT | AD-12258 |
| 1455 | CUAGAAGUACAUAAGACCU | 423 | cuAGAAGuAcAuAAGAccuTsT | 424 | AGGUCUuAUGuACUUcuAGTsT | AD-12259 |
| 1456 | UUGGAUCUCUCACAUCUAU | 425 | uuGGAucucucAcAucuAuTsT | 426 | AuAGAUGUGAGAGAUCcAATsT | AD-12260 |
| 1457 | AACUGUGGUGUCUAUACUG | 427 | AAcuGuGGuGucuAuAcuGTsT | 428 | cAGuAuAGAcACcAcAGUUTsT | AD-12261 |
| 1458 | UCAUUGACAGUGGCCGAUA | 429 | ucAuuGAcAGuGGccGAuATsT | 430 | uAUCGGccACUGUcAAUGATsT | AD-12262 |
| 1459 | AUAAAGCAGACCCAUUCCC | 431 | AuAAAGcAGAcccAuucccTsT | 432 | GGGAAUGGGUCUGCUUuAUTsT | AD-12263 |
| 1460 | ACAGAAACCACUUAGUAGU | 433 | AcAGAAAccAcuuAGuAGuTsT | 434 | ACuACuAAGUGGUUUCUGUTsT | AD-12264 |
| 1461 | GAAACCACUUAGUAGUGUC | 435 | GAAAccAcuuAGuAGuGucTsT | 436 | GAcACuACuAAGUGGUUUCTsT | AD-12265 |
| 1462 | AAAUCUAAGGAUAUAGUCA | 437 | AAAucuAAGGAuAuAGucATsT | 438 | UGAcuAuAUCCUuAGAUUUTsT | AD-12266 |
| 1463 | UUAUUUAUACCCAUCAACA | 439 | uuAuuuAuAcccAucAAcATsT | 440 | UGUUGAUGGGuAuAAAuAATsT | AD-12267 |
| 1464 | ACAGAGGCAUUAACACACU | 441 | AcAGAGGcAuuAAcAcAcuTsT | 442 | AGUGUGUuAAUGCCUCUGUTsT | AD-12268 |
| 1465 | ACACACUGGAGAGGUCUAA | 443 | AcAcAcuGGAGAGGucuAATsT | 444 | UuAGACCUCUCcAGUGUGUTsT | AD-12269 |
| 1466 | ACACUGGAGAGGUCUAAAG | 445 | AcAcuGGAGAGGucuAAAGTsT | 446 | CUUuAGACCUCUCcAGUGUTsT | AD-12270 |
| 1467 | CGAGCCCAGAUCAACCUUU | 447 | cGAGcccAGAucAAccuuuTsT | 448 | AAAGGUUGAUCUGGGCUCGTsT | AD-12271 |
| 1468 | UCCCUAUUUCGCUUUCUCC | 449 | ucccuAuuucGcuuucuccTsT | 450 | GGAGAAAGCGAAAuAGGGATsT | AD-12272 |
| 1469 | UCUAAAAUCACUGUCAACA | 451 | ucuAAAAucAcuGucAAcATsT | 452 | UGUUGAcAGUGAUUUuAGATsT | AD-12273 |
| 1470 | AGCCAAAUUCGUCUGCGAA | 453 | AGccAAAuucGucuGcGAATsT | 454 | UUCGcAGACGAAUUUGGCUTsT | AD-12274 |
| 1471 | CCCAUUCAAUAGUAGAAUG | 455 | cccAuucAAuAGuAGAAuGTsT | 456 | cAUUCuACuAUUGAAUGGGTsT | AD-12275 |
| 1472 | GAUGAAUGCAUACUCUAGU | 457 | GAuGAAuGcAuAcucuAGuTsT | 458 | ACuAGAGuAUGcAUUcAUCTsT | AD-12276 |
| 1473 | CUCAUGUUCCUUAUCGAGA | 459 | cucAuGuuccuuAucGAGATsT | 460 | UCUCGAuAAGGAAcAUGAGTsT | AD-12277 |
| 1474 | GAGAAUCUAAACUAACUAG | 461 | GAGAAucuAAAcuAAcuAGTsT | 462 | CuAGUuAGUUuAGAUUCUCTsT | AD-12278 |
| 1475 | UAGAAGUACAUAAGACCUU | 463 | uAGAAGuAcAuAAGAccuuTsT | 464 | AAGGUCUuAUGuACUUcuATsT | AD-12279 |
| 1476 | CAGCCUGAGCUGUUAAUGA | 465 | cAGccuGAGcuGuIiAAuGATsT | 466 | UcAUuAAcAGCUcAGGCUGTsT | AD-12280 |

TABLE 2a-continued

Sequences of Eg5/ KSP dsRNA duplexes

| SEQ ID NO: | sequence of 19-mer target site | SEQ ID NO. | sense sequence (5'-3') | SEQ ID NO. | antisense sequence (5'-3') | duplex name |
|---|---|---|---|---|---|---|
| 1477 | AAGAAGAGACAAUUCCGGA | 467 | AAGAAGAGAcAAuuccGGATsT | 468 | UCCGGAAUUGUCUCUUCUUTsT | AD-12281 |
| 1478 | UGCUGGUGUGGAUUGUUCA | 469 | uGcuGGuGuGGAuuGuucATsT | 470 | UGAAcAAUCcAcACcAGcATsT | AD-12282 |
| 1479 | AAAUUCGUCUGCGAAGAAG | 471 | AAAuucGucuGcGAAGAAGTsT | 472 | CUUCUUCGcAGACGAAUUUTsT | AD-12283 |
| 1480 | UUUCUGGAAGUUGAGAUGU | 473 | uuucuGGAAGuuGAGAuGuTsT | 474 | AcAUCUcAACUUCcAGAAATsT | AD-12284 |
| 1481 | UACUAAACAGAUUGAUGUU | 475 | uAcuAAAcAGAuuGAuGuuTsT | 476 | AAcAUcAAUCUGUUuAGuATsT | AD-12285 |
| 1482 | GAUUGAUGUUUACCGAAGU | 477 | GAuuGAuGuuuAccGAAGuTsT | 478 | ACUUCGGuAAAcAUcAAUCTsT | AD-12286 |
| 1483 | GCACUAUCUUUGCGUAUGG | 479 | GcAcuAucuuuGcGuAuGGTsT | 480 | CcAuACGcAAAGAuAGUGCTsT | AD-12287 |
| 1484 | UGGUAUAAUUCCACGUACC | 481 | uGGuAuAAuuccAcGuAccTsT | 482 | GGuACGUGGAAUuAuACcATsT | AD-12288 |
| 1485 | AGCAAGCUGCUUAACACAG | 483 | AGcAAGcuGcuuAAcAcAGTsT | 484 | CUGUGUuAAGcAGCUUGCUTsT | AD-12289 |
| 1486 | CAGAAACCACUUAGUAGUG | 485 | cAGAAAccAcuuAGuAGuGTsT | 486 | cACuACuAAGUGGUUUCUGTsT | AD-12290 |
| 1487 | AACUUAUUGGAGGUUGUAA | 487 | AAcuuAuuGGAGGuuGuAATsT | 488 | UuAcAACCUCcAAuAAGUUTsT | AD-12291 |
| 1488 | CUGGAGAGGUCUAAAGUGG | 489 | cuGGAGAGGucuAAAGuGGTsT | 490 | CcACUUuAGACCUCUCcAGTsT | AD-12292 |
| 1489 | AAAAAAGAUAUAAGGCAGU | 491 | AAAAAAGAuAuAAGGcAGuTsT | 492 | ACUGCCUuAuAUCUUUUUUTsT | AD-12293 |
| 1490 | GAAUUUUGAUAUCUACCCA | 493 | GAAuuuuGAuAucuAcccATsT | 494 | UGGGuAGAuAUcAAAAUUCTsT | AD-12294 |
| 1491 | GUAUUUUGAUCUGGCAAC | 495 | GuAuuuuuGAucuGGcAAcTsT | 496 | GUUGCcAGAUcAAAAAuACTsT | AD-12295 |
| 1492 | AGGAUCCCUUGGCUGGUAU | 497 | AGGAucccuuGGcuGGuAuTsT | 498 | AuAcCAGCcAAGGGAUCCUTsT | AD-12296 |
| 1493 | GGAUCCCUUGGCUGGUAUA | 499 | GGAucccuuGGcuGGuAuATsT | 500 | uAuAcCAGCcAAGGGAUCCTsT | AD-12297 |
| 1494 | CAAUAGUAGAAUGUGAUCC | 501 | cAAuAGuAGAAuGuGAuccTsT | 502 | GGAUcAcAUUCuAcuAUUGTsT | AD-12298 |
| 1495 | GCUAUAAUUGCACUAUCUU | 503 | GcuAuAAuuGcAcuAucuuTsT | 504 | AAGAuAGUGcAAUuAuAGCTsT | AD-12299 |
| 1496 | UACCCUUCAUCAAAUUUUU | 505 | uAcccuucAucAAAuuuuuTsT | 506 | AAAAAUUUGAUGAAGGGuATsT | AD-12300 |
| 1497 | AGAACAUAUUGAAUAAGCC | 507 | AGAAcAuAuuGAAuAAGccTsT | 508 | GGCUuAUUcAAuAUGUUCUTsT | AD-12301 |
| 1498 | AAAUUGGUGCUGUUGAGGA | 509 | AAAuuGGuGcuGuuGAGGATsT | 510 | UCCUcAAcAGcACcAAUUUTsT | AD-12302 |
| 1499 | UGAAUAGGGUUACAGAGUU | 511 | uGAAuAGGGuuAcAGAGuuTsT | 512 | AACUCUGuAACCCuAUUcATsT | AD-12303 |
| 1500 | AAGAACUUGAAACCACUCA | 513 | AAGAAcuuGAAAccAcucATsT | 514 | UGAGUGGUUUcAAGUUCUUTsT | AD-12304 |
| 1501 | AAUAAAGCAGACCCAUUCC | 515 | AAuAAAGcAGAcccAuuccTsT | 516 | GGAAUGGGUCUGCUUuAUUTsT | AD-12305 |
| 1502 | AUACCCAUCAACACUGGUA | 517 | AuAcccAucAAcAcuGGuATsT | 518 | uACcAGUGUUGAUGGGuAUTsT | AD-12306 |
| 1503 | UGGAUUGUUCAUCAAUUGG | 519 | uGGAuuGuucAucAAuuGGTsT | 520 | CcAAUUGAuGAAcAAUCcATsT | AD-12307 |
| 1504 | UGGAGAGGUCUAAAGUGGA | 521 | uGGAGAGGucuAAAGuGGATsT | 522 | UCcACUUuAGACCUCUCcATsT | AD-12308 |
| 1505 | GUCAUCCCUAUAGUUCACU | 523 | GucAucccuAuAGuucAcuTsT | 524 | AGUGAACuAuAGGGAUGACTsT | AD-12309 |
| 1506 | AUAAUGGCUAUAAUUUCUC | 525 | AuAAuGGcuAuAAuuucucTsT | 526 | GAGAAAuuAuAGCcAUuAUTsT | AD-12310 |
| 1507 | AUCCCUUGGCUGGUAUAAU | 527 | AucccuuGGcuGGuAuAAuTsT | 528 | AUuAuAcCAGCcAAGGGAUTsT | AD-12311 |
| 1508 | GGGCUAUAAUUGCACUAUC | 529 | GGGcuAuAAuuGcAcuAucTsT | 530 | GAuAGUGcAAUuAuAGCCCTsT | AD-12312 |
| 1509 | GAUUCUCUUGGAGGGCUA | 531 | GAuucucuuGGAGGGcGuATsT | 532 | uACGCCCUCcAAGAGAAUCTsT | AD-12313 |
| 1510 | GCAUCUCUCAAUCUUGAGG | 533 | GcAucucucAAucuuGAGGTsT | 534 | CCUcAAGAUUGAGAGAUGCTsT | AD-12314 |
| 1511 | CAGCAGAAAUCUAAGGAUA | 535 | cAGcAGAAAucuAAGGAuATsT | 536 | uAUCCUuAGAUUUCUGCUGTsT | AD-12315 |
| 1512 | GUCAAGAGCCAUCUGUAGA | 537 | GucAAGAGccAucuGuAGATsT | 538 | UCuAcAGAUGGCUCUUGACTsT | AD-12316 |
| 1513 | AAACAGAGGCAUUAACACA | 539 | AAAcAGAGGcAuuAAcAcATsT | 540 | UGUGUuAAUGCCUCUGUUUTsT | AD-12317 |

TABLE 2a-continued

Sequences of Eg5/ KSP dsRNA duplexes

| SEQ ID NO. | sequence of 19-mer target site | SEQ ID NO. | sense sequence (5'-3') | SEQ ID NO. | antisense sequence (5'-3') | duplex name |
|---|---|---|---|---|---|---|
| 1514 | AGCCCAGAUCAACCUUUAA | 541 | AGcccAGAucAAccuuuAATsT | 542 | UuAAAGGUUGAUCUGGGCUTsT | AD-12318 |
| 1515 | UAUUUUUGAUCUGGCAACC | 543 | uAuuuuuGAucuGGcAAccTsT | 544 | GGUUGCcAGAUcAAAAAuATsT | AD-12319 |
| 1516 | UGUUUGGAGCAUCUACUAA | 545 | uGuuuGGAGcAucuAcuAATsT | 546 | UuAGuAGAUGCUCcAAAcATsT | AD-12320 |
| 1517 | GAAAUUACAGUACACAACA | 547 | GAAAuuAcAGuAcAcAAcATsT | 548 | UGUUGUGuACUGuAAUUUCTsT | AD-12321 |
| 1518 | ACUUGACCAGUGUAAAUCU | 549 | AcuuGAccAGuGuAAAucuTsT | 550 | AGAUUuAcACUGGUcAAGUTsT | AD-12322 |
| 1519 | ACCAGUGUAAAUCUGACCU | 551 | AccAGuGuAAAucuGAccuTsT | 552 | AGGUcAGAUUuAcACUGGUTsT | AD-12323 |
| 1520 | AGAACAAUCAUUAGCAGCA | 553 | AGAAcAAucAuuAGcAGcATsT | 554 | UGCUGCuAAUGAUUGUUCUTsT | AD-12324 |
| 1521 | CAAUGUGGAAACCUAACUG | 555 | cAAuGuGGAAAccuAAcuGTsT | 556 | cAGUuAGGUUUCcAcAUUGTsT | AD-12325 |
| 1522 | ACCAAGAAGGUACAAAAUU | 557 | AccAAGAAGGuAcAAAAuuTsT | 558 | AAUUUUGuACCUUCUUGGUTsT | AD-12326 |
| 1523 | GGUACAAAAUUGGUUGAAG | 559 | GGuAcAAAAuuGGuuGAAGTsT | 560 | CUUcAACcAAUUUUGuACCTsT | AD-12327 |
| 1524 | GGUGUGGAUUGUUCAUCAA | 561 | GGuGuGGAuuGuucAucAATsT | 562 | UUGAUGAAcAAUCcAcACCTsT | AD-12328 |
| 1525 | AGAGUUCACAAAAAGCCCA | 563 | AGAGuucAcAAAAAGcccATsT | 564 | UGGGCUUUUUGUGAACUCUTsT | AD-12329 |
| 1526 | UGAUAGCUAAAUUAAACCA | 565 | uGAuAGcuAAAuuAAAccATsT | 566 | UGGUUuAAUUuAGCuAUcATsT | AD-12330 |
| 1527 | AAUAAGCCUGAAGUGAAUC | 567 | AAuAAGccuGAAGuGAAucTsT | 568 | GAUUcACUUcAGGCUuAUUTsT | AD-12331 |
| 1528 | CAGUUGACCAACACAAUGC | 569 | cAGuuGAccAAcAcAAuGcTsT | 570 | GcAUUGUGUUGGUcAACUGTsT | AD-12332 |
| 1529 | UGGUGUGGAUUGUUCAUCA | 571 | uGGuGuGGAuuGuucAucATsT | 572 | UGAUGAAcAAUCcAcACCATsT | AD-12333 |
| 1530 | AUUCACCCUGACAGAGUUC | 573 | AuucAcccuGAcAGAGuucTsT | 574 | GAACUCUGUcAGGGUGAAUTsT | AD-12334 |
| 1531 | UAAGACCUUAUUUGGUAAU | 575 | uAAGAccuuAuuuGGuAAuTsT | 576 | AUuACcAAAuAAGGUCUuATsT | AD-12335 |
| 1532 | AAGCAAUGUGGAAACCUAA | 577 | AAGcAAuGuGGAAAccuAATsT | 578 | UuAGGUUUCcAcAUUGCUUTsT | AD-12336 |
| 1533 | UCUGAAACUGGAUAUCCCA | 579 | ucuGAAAcuGGAuAucccATsT | 580 | UGGGAuAUCcAGUUUcAGATsT | AD-12337 |

TABLE 2b

Analysis of Eg5/KSP dsRNA duplexes

| Eg5/KSP duplex name | 1st single dose screen @ 50 nM [% residual mRNA] | SDs 1st screen (among quadruplicates) | 2nd single dose screen @ 25 nM [% residual mRNA] | SDs 2nd screen (among quadruplicates) | 3rd single dose screen @ 25 nM | SDs 3rd screen (among quadruplicates) |
|---|---|---|---|---|---|---|
| AD-12072 | 65% | 2% | 82% | 5% | | |
| AD-12073 | 84% | 1% | 61% | 6% | | |
| AD-12074 | 51% | 3% | 36% | 9% | | |
| AD-12075 | 56% | 4% | 36% | 4% | | |
| AD-12076 | 21% | 4% | 13% | 3% | | |
| AD-12077 | 11% | 2% | 6% | 1% | | |
| AD-12078 | 22% | 3% | 9% | 2% | | |
| AD-12079 | 22% | 10% | 15% | 7% | | |
| AD-12080 | 68% | 4% | 52% | 13% | | |
| AD-12081 | 34% | 8% | 35% | 24% | | |
| AD-12082 | 20% | 2% | 92% | 5% | | |
| AD-12083 | 85% | 6% | 63% | 10% | | |
| AD-12084 | 18% | 6% | 17% | 4% | | |
| AD-12085 | 13% | 4% | 12% | 4% | | |
| AD-12086 | 26% | 5% | 17% | 3% | | |
| AD-12087 | 95% | 4% | 80% | 4% | | |
| AD-12088 | 29% | 6% | 29% | 2% | | |
| AD-12089 | 69% | 5% | 64% | 7% | | |
| AD-12090 | 46% | 15% | 34% | 5% | | |

TABLE 2b-continued

Analysis of Eg5/KSP dsRNA duplexes

| Eg5/KSP duplex name | 1st single dose screen @ 50 nM [% resudual mRNA] | SDs 1st screen (among quadruplicates) | 2nd single dose screen @ 25 nM [% resudual mRNA] | SDs 2nd screen (among quadruplicates) | 3rd single dose screen @ 25 nM | SDs 3rd screen (among quadruplicates) |
|---|---|---|---|---|---|---|
| AD-12091 | 16% | 6% | 17% | 3% | | |
| AD-12092 | 82% | 26% | 63% | 5% | | |
| AD-12093 | 84% | 4% | 70% | 4% | | |
| AD-12094 | 46% | 3% | 34% | 1% | | |
| AD-12095 | 14% | 2% | 13% | 1% | | |
| AD-12096 | 26% | 11% | 17% | 1% | | |
| AD-12097 | 23% | 2% | 21% | 1% | | |
| AD-12098 | 41% | 14% | 17% | 3% | | |
| AD-12099 | 57% | 2% | 48% | 6% | | |
| AD-12100 | 101% | 11% | 98% | 8% | | |
| AD-12101 | 46% | 7% | 32% | 2% | | |
| AD-12102 | 96% | 17% | 88% | 18% | | |
| AD-12103 | 19% | 5% | 20% | 2% | | |
| AD-12104 | 40% | 8% | 24% | 2% | | |
| AD-12105 | 39% | 2% | 36% | 10% | | |
| AD-12106 | 87% | 6% | 79% | 19% | | |
| AD-12107 | 29% | 2% | 32% | 16% | | |
| AD-12108 | 38% | 4% | 39% | 8% | | |
| AD-12109 | 49% | 3% | 44% | 10% | | |
| AD-12110 | 85% | 5% | 80% | 14% | | |
| AD-12111 | 64% | 6% | 71% | 18% | | |
| AD-12112 | 48% | 4% | 41% | 5% | | |
| AD-12113 | 13% | 0% | 14% | 3% | | |
| AD-12114 | 32% | 6% | 16% | 4% | | |
| AD-12115 | 8% | 4% | 7% | 5% | | |
| AD-12116 | 74% | 5% | 61% | 7% | | |
| AD-12117 | 21% | 4% | 20% | 2% | | |
| AD-12118 | 44% | 4% | 42% | 6% | | |
| AD-12119 | 37% | 4% | 24% | 3% | | |
| AD-12120 | 22% | 2% | 15% | 4% | | |
| AD-12121 | 32% | 1% | 22% | 2% | | |
| AD-12122 | 36% | 16% | 19% | 5% | | |
| AD-12123 | 28% | 1% | 16% | | | |
| AD-12124 | 28% | 2% | 16% | | | |
| AD-12125 | 15% | 1% | 14% | | | |
| AD-12126 | 51% | 22% | 27% | | | |
| AD-12127 | 54% | 4% | 42% | 9% | | |
| AD-12128 | 29% | 1% | 20% | 2% | | |
| AD-12129 | 22% | 3% | 19% | 3% | | |
| AD-12130 | 53% | 6% | 42% | 7% | | |
| AD-12131 | 28% | 5% | 22% | 3% | | |
| AD-12132 | 88% | 2% | 90% | 18% | | |
| AD-12133 | 34% | 2% | 26% | 6% | | |
| AD-12134 | 18% | 3% | 14% | 2% | | |
| AD-12135 | 50% | 6% | 37% | 4% | | |
| AD-12136 | 42% | 19% | 22% | 2% | | |
| AD-12137 | 85% | 12% | 92% | 4% | | |
| AD-12138 | 47% | 6% | 49% | 1% | | |
| AD-12139 | 80% | 5% | 72% | 4% | | |
| AD-12140 | 97% | 22% | 67% | 9% | | |
| AD-12141 | 120% | 4% | 107% | 10% | | |
| AD-12142 | 55% | 8% | 33% | 4% | | |
| AD-12143 | 64% | 34% | 19% | 2% | | |
| AD-12144 | 58% | 29% | 17% | 2% | | |
| AD-12145 | 27% | 8% | 18% | 2% | | |
| AD-12146 | 19% | 20% | 15% | 1% | | |
| AD-12147 | 29% | 9% | 35% | 3% | | |
| AD-12148 | 30% | 3% | 56% | 5% | | |
| AD-12149 | 8% | 2% | 12% | 3% | | |
| AD-12150 | 31% | 2% | 31% | 7% | | |
| AD-12151 | 9% | 5% | 14% | 2% | | |
| AD-12152 | 3% | 3% | 23% | 3% | | |
| AD-12153 | 20% | 6% | 34% | 4% | | |
| AD-12154 | 24% | 7% | 44% | 3% | | |
| AD-12155 | 33% | 6% | 53% | 11% | | |
| AD-12156 | 35% | 5% | 40% | 5% | | |
| AD-12157 | 8% | 3% | 23% | 4% | | |
| AD-12158 | 13% | 2% | 22% | 5% | | |
| AD-12159 | 34% | 6% | 46% | 5% | | |
| AD-12160 | 19% | 3% | 31% | 4% | | |

TABLE 2b-continued

Analysis of Eg5/KSP dsRNA duplexes

| Eg5/KSP duplex name | 1st single dose screen @ 50 nM [% resudual mRNA] | SDs 1st screen (among quadruplicates) | 2nd single dose screen @ 25 nM [% resudual mRNA] | SDs 2nd screen (among quadruplicates) | 3rd single dose screen @ 25 nM | SDs 3rd screen (among quadruplicates) |
|---|---|---|---|---|---|---|
| AD-12161 | 88% | 4% | 83% | 7% | | |
| AD-12162 | 26% | 7% | 32% | 7% | | |
| AD-12163 | 55% | 9% | 40% | 3% | | |
| AD-12164 | | | 21% | 3% | | |
| AD-12165 | 30% | 3% | 41% | 4% | | |
| AD-12166 | 9% | 10% | 22% | 9% | | |
| AD-12167 | 26% | 3% | 30% | 2% | | |
| AD-12168 | 54% | 4% | 59% | 20% | | |
| AD-12169 | 41% | 4% | 51% | 16% | | |
| AD-12170 | 43% | 4% | 52% | 20% | | |
| AD-12171 | 67% | 3% | 73% | 25% | | |
| AD-12172 | 53% | 15% | 37% | 2% | | |
| AD-12173 | 39% | 0% | 39% | 0% | | |
| AD-12174 | 41% | 5% | 27% | 0% | | |
| AD-12175 | 29% | 0% | 38% | 14% | | |
| AD-12176 | 43% | 2% | 56% | 25% | | |
| AD-12177 | 68% | 6% | 74% | 30% | | |
| AD-12178 | 41% | 4% | 41% | 6% | | |
| AD-12179 | 53% | 5% | 44% | 5% | | |
| AD-12180 | 16% | 2% | 13% | 4% | | |
| AD-12181 | 19% | 3% | 14% | 2% | | |
| AD-12182 | 16% | 4% | 18% | 8% | | |
| AD-12183 | 26% | 3% | 19% | 4% | | |
| AD-12184 | 54% | 2% | 77% | 8% | | |
| AD-12185 | 8% | 1% | 9% | 1% | | |
| AD-12186 | 36% | 3% | 41% | 6% | | |
| AD-12187 | 34% | 17% | 27% | 1% | | |
| AD-12188 | 30% | 3% | 27% | 4% | | |
| AD-12189 | 51% | 4% | 48% | 5% | | |
| AD-12190 | 33% | 2% | 26% | 4% | | |
| AD-12191 | 20% | 2% | 13% | 0% | | |
| AD-12192 | 21% | 1% | 23% | 10% | | |
| AD-12193 | 64% | 8% | 98% | 6% | | |
| AD-12194 | 8% | 2% | 15% | 4% | | |
| AD-12195 | 34% | 2% | 48% | 3% | | |
| AD-12196 | 34% | 2% | 51% | 3% | | |
| AD-12197 | 75% | 4% | 93% | 6% | | |
| AD-12198 | 55% | 5% | 48% | 2% | | |
| AD-12199 | 102% | 6% | 118% | 9% | | |
| AD-12200 | 75% | 6% | 60% | 12% | | |
| AD-12201 | 42% | 3% | 16% | 4% | | |
| AD-12202 | 29% | 4% | 9% | 3% | | |
| AD-12203 | 114% | 14% | 89% | 20% | | |
| AD-12204 | 64% | 7% | 26% | 5% | | |
| AD-12205 | 66% | 12% | 35% | 4% | | |
| AD-12206 | 46% | 3% | 32% | 12% | | |
| AD-12207 | 57% | 5% | 40% | 6% | | |
| AD-12208 | 30% | 8% | 10% | 5% | | |
| AD-12209 | 101% | 6% | 102% | 23% | | |
| AD-12210 | 38% | 11% | 27% | 14% | | |
| AD-12211 | 16% | 6% | 10% | 5% | | |
| AD-12212 | 59% | 8% | 65% | 5% | | |
| AD-12213 | 24% | 9% | 12% | 2% | | |
| AD-12214 | 67% | 14% | 70% | 12% | | |
| AD-12215 | 29% | 13% | 13% | 4% | | |
| AD-12216 | 36% | 4% | 13% | 1% | | |
| AD-12217 | 36% | 9% | 11% | 2% | | |
| AD-12218 | 35% | 5% | 17% | 3% | | |
| AD-12219 | 41% | 9% | 14% | 1% | | |
| AD-12220 | 37% | 5% | 23% | 3% | | |
| AD-12221 | 58% | 7% | 39% | 6% | | |
| AD-12222 | 74% | 9% | 53% | 3% | | |
| AD-12223 | 74% | 10% | 67% | 7% | | |
| AD-12224 | 24% | 2% | 11% | 2% | | |
| AD-12225 | 75% | 5% | 76% | 14% | | |
| AD-12226 | 45% | 8% | 40% | 3% | | |
| AD-12227 | 61% | 6% | 47% | 5% | | |
| AD-12228 | 28% | 3% | 25% | 5% | | |
| AD-12229 | 54% | 13% | 37% | 6% | | |
| AD-12230 | 70% | 17% | 65% | 4% | | |

TABLE 2b-continued

Analysis of Eg5/KSP dsRNA duplexes

| Eg5/KSP duplex name | 1st single dose screen @ 50 nM [% resudual mRNA] | SDs 1st screen (among quadruplicates) | 2nd single dose screen @ 25 nM [% resudual mRNA] | SDs 2nd screen (among quadruplicates) | 3rd single dose screen @ 25 nM | SDs 3rd screen (among quadruplicates) |
|---|---|---|---|---|---|---|
| AD-12231 | 32% | 12% | 22% | 6% | | |
| AD-12232 | 30% | 3% | 17% | 2% | | |
| AD-12233 | 38% | 2% | 32% | 3% | | |
| AD-12234 | 90% | 5% | 95% | 7% | | |
| AD-12235 | 57% | 7% | 46% | 3% | | |
| AD-12236 | 34% | 8% | 16% | 2% | | |
| AD-12237 | 42% | 9% | 32% | 8% | | |
| AD-12238 | 42% | 6% | 34% | 6% | | |
| AD-12239 | 42% | 3% | 40% | 4% | | |
| AD-12240 | 47% | 6% | 36% | 5% | | |
| AD-12241 | 69% | 5% | 70% | 8% | | |
| AD-12242 | 61% | 2% | 47% | 3% | | |
| AD-12243 | 26% | 7% | 15% | 1% | | |
| AD-12244 | 25% | 6% | 15% | 1% | | |
| AD-12245 | 65% | 6% | 83% | 13% | | |
| AD-12246 | 29% | 7% | 31% | 6% | | |
| AD-12247 | 57% | 13% | 50% | 3% | | |
| AD-12248 | 36% | 8% | 20% | 3% | 15% | 7% |
| AD-12249 | 44% | 3% | 70% | 11% | 103% | 34% |
| AD-12250 | 47% | 5% | 18% | 5% | 17% | 4% |
| AD-12251 | 121% | 28% | 35% | 8% | 60% | 42% |
| AD-12252 | 94% | 19% | 8% | 3% | 5% | 3% |
| AD-12253 | 94% | 33% | 42% | 8% | 49% | 27% |
| AD-12254 | 101% | 58% | 70% | 5% | 80% | 32% |
| AD-12255 | 163% | 27% | 28% | 6% | 36% | 10% |
| AD-12256 | 112% | 62% | 18% | 3% | 9% | 4% |
| AD-12257 | 10% | 4% | 9% | 2% | 6% | 2% |
| AD-12258 | 27% | 9% | 18% | 3% | 20% | 6% |
| AD-12259 | 20% | 5% | 12% | 2% | 13% | 5% |
| AD-12260 | 22% | 7% | 81% | 7% | 65% | 13% |
| AD-12261 | 122% | 11% | 66% | 7% | 80% | 22% |
| AD-12262 | 97% | 30% | 33% | 6% | 44% | 18% |
| AD-12263 | 177% | 57% | 85% | 11% | 84% | 15% |
| AD-12264 | 37% | 6% | 10% | 1% | 10% | 4% |
| AD-12265 | 40% | 8% | 17% | 1% | 20% | 10% |
| AD-12266 | 33% | 9% | 9% | 1% | 8% | 4% |
| AD-12267 | 34% | 13% | 11% | 1% | 6% | 2% |
| AD-12268 | 34% | 6% | 11% | 1% | 9% | 2% |
| AD-12269 | 54% | 6% | 33% | 4% | 29% | 7% |
| AD-12270 | 52% | 5% | 29% | 4% | 27% | 6% |
| AD-12271 | 53% | 7% | 27% | 3% | 19% | 6% |
| AD-12272 | 85% | 15% | 57% | 7% | 51% | 16% |
| AD-12273 | 36% | 6% | 26% | 2% | 30% | 5% |
| AD-12274 | 75% | 21% | 40% | 2% | 50% | 19% |
| AD-12275 | 29% | 9% | 8% | 1% | 8% | 4% |
| AD-12276 | 45% | 19% | 15% | 2% | 16% | 12% |
| AD-12277 | 58% | 17% | 32% | 2% | 55% | 14% |
| AD-12278 | 120% | 35% | 96% | 10% | 124% | 38% |
| AD-12279 | 47% | 29% | 17% | 1% | 12% | 4% |
| AD-12280 | 2% | 0% | 3% | 1% | | |
| AD-12281 | 2% | 0% | 5% | 2% | | |
| AD-12282 | 3% | 0% | 25% | 5% | | |
| AD-12283 | 3% | 1% | 35% | 4% | | |
| AD-12284 | 5% | 2% | 49% | 8% | | |
| AD-12285 | 7% | 7% | 21% | 26% | | |
| AD-12286 | 28% | 34% | 12% | 7% | | |
| AD-12287 | 40% | 21% | 51% | 23% | | |
| AD-12288 | 26% | 7% | 155% | 146% | | |
| AD-12289 | 43% | 21% | 220% | 131% | | |
| AD-12290 | 2% | 1% | 81% | 23% | | |
| AD-12291 | 4% | 1% | 70% | 3% | | |
| AD-12292 | 2% | 1% | 6% | 2% | | |
| AD-12293 | 4% | 2% | 36% | 3% | | |
| AD-12294 | 10% | 6% | 38% | 3% | | |
| AD-12295 | 29% | 31% | 37% | 3% | | |
| AD-12296 | 82% | 4% | 89% | 2% | | |
| AD-12297 | 75% | 3% | 65% | 2% | | |
| AD-12298 | 73% | 4% | 60% | 3% | | |
| AD-12299 | 76% | 4% | 66% | 4% | | |
| AD-12300 | 36% | 4% | 15% | 1% | | |

TABLE 2b-continued

Analysis of Eg5/KSP dsRNA duplexes

| Eg5/KSP duplex name | 1st single dose screen @ 50 nM [% resudual mRNA] | SDs 1st screen (among quadruplicates) | 2nd single dose screen @ 25 nM [% residual mRNA] | SDs 2nd screen (among quadruplicates) | 3rd single dose screen @ 25 nM | SDs 3rd screen (among quadruplicates) |
|---|---|---|---|---|---|---|
| AD-12301 | 33% | 4% | 18% | 2% | | |
| AD-12302 | 66% | 5% | 65% | 3% | | |
| AD-12303 | 35% | 6% | 17% | 2% | | |
| AD-12304 | 70% | 8% | 70% | 6% | | |
| AD-12305 | 63% | 8% | 80% | 7% | | |
| AD-12306 | 23% | 6% | 20% | 3% | | |
| AD-12307 | 78% | 10% | 58% | 5% | | |
| AD-12308 | 27% | 8% | 15% | 2% | | |
| AD-12309 | 58% | 11% | 42% | 3% | | |
| AD-12310 | 106% | 23% | 80% | 2% | | |
| AD-12311 | 73% | 12% | 60% | 2% | | |
| AD-12312 | 39% | 3% | 36% | 3% | | |
| AD-12313 | 64% | 9% | 49% | 6% | | |
| AD-12314 | 28% | 7% | 14% | 6% | | |
| AD-12315 | 31% | 7% | 13% | 2% | | |
| AD-12316 | 42% | 5% | 14% | 2% | | |
| AD-12317 | 34% | 9% | 15% | 5% | | |
| AD-12318 | 46% | 4% | 28% | 4% | | |
| AD-12319 | 77% | 3% | 56% | 4% | | |
| AD-12320 | 55% | 7% | 41% | 3% | | |
| AD-12321 | 21% | 3% | 10% | 2% | | |
| AD-12322 | 27% | 8% | 30% | 12% | | |
| AD-12323 | 26% | 7% | 35% | 18% | | |
| AD-12324 | 27% | 8% | 27% | 14% | | |
| AD-12325 | 32% | 12% | 32% | 22% | | |
| AD-12326 | 42% | 22% | 45% | 41% | | |
| AD-12327 | 36% | 14% | 37% | 32% | | |
| AD-12328 | 45% | 2% | 31% | 3% | | |
| AD-12329 | 61% | 4% | 34% | 3% | | |
| AD-12330 | 63% | 5% | 38% | 4% | | |
| AD-12331 | 50% | 2% | 26% | 5% | | |
| AD-12332 | 80% | 4% | 51% | 7% | | |
| AD-12333 | 34% | 6% | 12% | 2% | | |
| AD-12334 | 27% | 2% | 18% | 3% | | |
| AD-12335 | 84% | 6% | 60% | 7% | | |
| AD-12336 | 45% | 4% | 36% | 4% | | |
| AD-12337 | 30% | 7% | 19% | 2% | | |

TABLE 3

Sequences and analysis of Eg5/KSP dsRNA duplexes

| Sense sequence (5'-3') | SEQ ID NO. | Antisense sequence (5'-3') | SEQ ID NO. | duplex name | single dose screen @ 25 nM [% residual mRNA] | SDs 2nd screen (among quadru-plicates) |
|---|---|---|---|---|---|---|
| ccAuuAcuAcAGuAGcAcuTsT | 582 | AGUGCuACUGuAGuAAUGGTsT | 583 | AD-14085 | 19% | 1% |
| AucuGGcAAccAuAuuucuTsT | 584 | AGAAAuAUGGUUGCcAGAUTsT | 585 | AD-14086 | 38% | 1% |
| GAuAGcuAAAuuAAAccAATsT | 586 | UUGGUUuAAUUuAGCuAUCTsT | 587 | AD-14087 | 75% | 10% |
| AGAuAccAuuAcuAcAGuATsT | 588 | uACUGuAGuAAUGGuAUCUTsT | 589 | AD-14088 | 22% | 8% |
| GAuuGuucAucAAuuGGcGTsT | 590 | CGCcAAUUGAUGAAcAAUCTsT | 591 | AD-14089 | 70% | 12% |
| GcuuucccucGGcucAcuTsT | 592 | AGuGAGCCGAGGAGAAAGCTsT | 593 | AD-14090 | 79% | 11% |
| GGAGGAuuGGcuGAcAAGATsT | 594 | UCUUGUcAGCcAAUCCUCCTsT | 595 | AD-14091 | 29% | 3% |
| uAAuGAAGAGuAuAccGGTsT | 596 | CcAGGuAuACUCUUcAUuATsT | 597 | AD-14092 | 23% | 2% |
| uuucAccAAAccAuuuGuATsT | 598 | uAcAAAUGGUUUGGUGAAATsT | 599 | AD-14093 | 60% | 2% |

TABLE 3-continued

Sequences and analysis of Eg5/KSP dsRNA duplexes

| Sense sequence (5'-3') | SEQ ID NO. | Antisense sequence (5'-3') | SEQ ID NO. | duplex name | single dose screen @ 25 nM [% residual mRNA] | SDs 2nd screen (among quadru-plicates) |
|---|---|---|---|---|---|---|
| cuuAuuAAGGAGuAuAcGGTsT | 600 | CCGuAuACUCCUuAAuAAGTsT | 601 | AD-14094 | 11% | 3% |
| GAAAucAGAuGGAcGuAAGTsT | 602 | CUuACGUCcAUCUGAUUUCTsT | 603 | AD-14095 | 10% | 2% |
| cAGAuGucAGcAuAAGcGATsT | 604 | UCGCUuAUGCUGAcAUCUGTsT | 605 | AD-14096 | 27% | 2% |
| AucuAAcccuAGuuGuAucTsT | 606 | GAuAcAACuAGGGUuAGAUTsT | 607 | AD-14097 | 45% | 6% |
| AAGAGcuuGuuAAAAucGGTsT | 608 | CCGAUUUuAAcAAGCUCUUTsT | 609 | AD-14098 | 50% | 10% |
| uuAAGGAGuAuAcGGAGGATsT | 610 | UCCUCCGuAuACUCCUuAATsT | 611 | AD-14099 | 12% | 4% |
| uuGcAAuGuAAAuAcGAuTsT | 612 | AuACGuAUUuAcAUUGcAATsT | 613 | AD-14100 | 49% | 7% |
| ucuAAcccuAGuuGuAuccTsT | 614 | GGAuAcAACuAGGGUuAGATsT | 615 | AD-14101 | 36% | 1% |
| cAuGuAucuuuuucucGAuTsT | 616 | AUCGAGAAAAAGAuAcAUGTsT | 617 | AD-14102 | 49% | 3% |
| GAuGucAGcAuAAGcGAuGTsT | 618 | cAUCGCUuAUGCUGAcAUCTsT | 619 | AD-14103 | 74% | 5% |
| ucccAAcAGGuAcGAcAccTsT | 620 | GGGuGUCGuACCUGUUGGGATsT | 621 | AD-14104 | 27% | 3% |
| uGcucAcGAuGAGuuuAGuTsT | 622 | ACuAAACUcAUCGUGAGcATsT | 623 | AD-14105 | 34% | 4% |
| AGAGcuuGuuAAAAucGGATsT | 624 | UCCGAUUUuAAcAAGCUCUTsT | 625 | AD-14106 | 9% | 2% |
| GcGuAcAAGAAcAucuAuATsT | 626 | uAuAGAUGUUCUUGuACGCTsT | 627 | AD-14107 | 5% | 1% |
| GAGGuuGuAAGccAAuGuuTsT | 628 | AAcAUUGGCUuAcAACCUCTsT | 629 | AD-14108 | 15% | 1% |
| AAcAGGuAcGAcAccAcAGTsT | 630 | CUGUGGUGUCGuACCUGUUTsT | 631 | AD-14109 | 91% | 2% |
| AAcccuAGuuGuAucccucTsT | 632 | GAGGGAuAcAACuAGGGUUTsT | 633 | AD-14110 | 66% | 5% |
| GcAuAAGcGAuGGAuAAuATsT | 634 | uAUuAUCcAUCGCUuAUGCTsT | 635 | AD-14111 | 33% | 3% |
| AAGcGAuGGAuAAuAccuATsT | 636 | uAGGuAUuAUCcAUCGCUUTsT | 637 | AD-14112 | 51% | 3% |
| uGAuccuGuAcGAAAAGAATsT | 638 | UUCUUUUCGuAcAGGAUcATsT | 639 | AD-14113 | 22% | 3% |
| AAAAcAuuGGccGuucuGGTsT | 640 | CcAGAACGGCcAAUGUUUUTsT | 641 | AD-14114 | 117% | 8% |
| cuuGGAGGGcGuAcAAGAATsT | 642 | UUCUUGuACGCCCUCCAAGTsT | 643 | AD-14115 | 50% | 8% |
| GGcGuAcAAGAAcAucuAuTsT | 644 | AuAGAUGUUCUUGuACGCCTsT | 645 | AD-14116 | 14% | 3% |
| AcucuGAGuAcAuuGGAAuTsT | 646 | AUUCcAAUGuACUcAGAGUTsT | 647 | AD-14117 | 12% | 4% |
| uuAuuAAGGAGuAuAcGGATsT | 648 | UCCGuAuACUCCUuAAuAATsT | 649 | AD-14118 | 26% | 4% |
| uAAGGAGuAuAcGGAGGAGTsT | 650 | CUCCUCCGuAuACUCCUuATsT | 651 | AD-14119 | 24% | 5% |
| AAAucAAuAGucAAcuAAATsT | 652 | UUuAGUUGACuAUUGAUUUTsT | 653 | AD-14120 | 8% | 1% |
| AAucAAuAGucAAcuAAAGTsT | 654 | CUUuAGUUGACuAUUGAUUTsT | 655 | AD-14121 | 24% | 2% |
| uucucAGuAuAcuGuGuAATsT | 656 | UuAcAcAGuAuACUGAGAATsT | 657 | AD-14122 | 10% | 1% |
| uGuGAAAcAcucuGAuAAATsT | 658 | UUuAUcAGAGUGUUUcAcATsT | 659 | AD-14123 | 8% | 1% |
| AGAuGuGAAucucuGAAcATsT | 660 | UGUUcAGAGAUUcAcAUCUTsT | 661 | AD-14124 | 9% | 2% |
| AGGuuGuAAGccAAuGuuGTsT | 662 | cAAcAUUGGCUuAcAACCUTsT | 663 | AD-14125 | 114% | 6% |
| uGAGAAucAGAuGGAcGuTsT | 664 | ACGUCcAUCUGAUUUCuATsT | 665 | AD-14126 | 9% | 1% |
| AGAAucAGAuGGAcGuAATsT | 666 | UuACGUCcAUCUGAUUUCUTsT | 667 | AD-14127 | 57% | 6% |
| AuAucccAAcAGGuAcGAcTsT | 668 | GUCGuACCUGUUGGGAuAUTsT | 669 | AD-14128 | 104% | 6% |

TABLE 3-continued

Sequences and analysis of Eg5/KSP dsRNA duplexes

| Sense sequence (5'-3') | SEQ ID NO. | Antisense sequence (5'-3') | SEQ ID NO. | duplex name | single dose screen @ 25 nM [% residual mRNA] | SDs 2nd screen (among quadruplicates) |
|---|---|---|---|---|---|---|
| cccAAcAGGuAcGAcAccATsT | 670 | UGGUGUCGuACCUGUUGGGTsT | 671 | AD-14129 | 21% | 2% |
| AGuAuAcuGAAGAAccucuTsT | 672 | AGAGGUUCUUcAGuAuACUTsT | 673 | AD-14130 | 57% | 6% |
| AuAuAuAucAGccGGGcGcTsT | 674 | GCGCCCGGCUGAuAuAuAUTsT | 675 | AD-14131 | 93% | 6% |
| AAucuAAcccuAGuuGuAuTsT | 676 | AuAcAACuAGGGUuAGAUUTsT | 677 | AD-14132 | 75% | 8% |
| cuAAcccuAGuuGuAucccTsT | 678 | GGGAuAcAACuAGGGUuAGTsT | 679 | AD-14133 | 66% | 4% |
| cuAGuuGuAucccuccuuuTsT | 680 | AAAGGAGGGAuAcAACuAGTsT | 681 | AD-14134 | 44% | 6% |
| AGAcAucuGAcuAAuGGcuTsT | 682 | AGCcAUuAGUcAGAUGUCUTsT | 683 | AD-14135 | 55% | 6% |
| GAAGcucAcAAuGAuuuAATsT | 684 | UuAAAUcAUUGUGAGCUUCTsT | 685 | AD-14136 | 29% | 3% |
| AcAuGuAucuuuucucGATsT | 686 | UCGAGAAAAGAuAcAUGUTsT | 687 | AD-14137 | 40% | 3% |
| ucGAuucAAAucuuAAcccTsT | 688 | GGGUuAAGAUUUGAAUCGATsT | 689 | AD-14138 | 39% | 5% |
| ucuuAAcccuuAGGAcucuTsT | 690 | AGAGUCCuAAGGGUuAAGATsT | 691 | AD-14139 | 71% | 11% |
| GcucAcGAuGAGuuuAGuGTsT | 692 | cACuAAACUcAUCGUGAGCTsT | 693 | AD-14140 | 43% | 15% |
| cAuAAGcGAuGGAuAAuAcTsT | 694 | GuAUuAUCcAUCGCUuAUGTsT | 695 | AD-14141 | 33% | 6% |
| AuAAGcGAuGGAuAAuAccTsT | 696 | GGuAUuAUCcAUCGCUuAUTsT | 697 | AD-14142 | 51% | 14% |
| ccuAuAAAcuGcccucAGTsT | 698 | CUGAGGGcAGUUuAUuAGGTsT | 699 | AD-14143 | 42% | 1% |
| ucGGAAAGuuGAAcuuGGuTsT | 700 | ACcAAGUUcAACUUUCCGATsT | 701 | AD-14144 | 4% | 4% |
| GAAAAcAuuGGccGuucuGTsT | 702 | cAGAACGGCcAAUGUUUUCTsT | 703 | AD-14145 | 92% | 5% |
| AAGAcuGAucuucuAAGuuTsT | 704 | AACuuAGAAGAUcAGUCUUTsT | 705 | AD-14146 | 13% | 2% |
| GAGcuuGuuAAAAucGGAATsT | 706 | UUCCGAUUUuAAcAAGCUCTsT | 707 | AD-14147 | 8% | 1% |
| AcAuuGGccGuucuGGAGcTsT | 708 | GCUCcAGAACGGCcAAUGUTsT | 709 | AD-14148 | 80% | 7% |
| AAGAAcAucuAuAuuGcATsT | 710 | UGcAAUuAuAGAUGUUCUUTsT | 711 | AD-14149 | 44% | 7% |
| AAAuGucucAcucAuGuuTsT | 712 | AAcAUGAGuGAGAcAcAUUUTsT | 713 | AD-14150 | 32% | 29% |
| uGucuAcucAuGuuucucATsT | 714 | UGAGAAAcAUGAGuAGAcATsT | 715 | AD-14151 | 75% | 11% |
| GuAuAcuGuGuAAcAAucuTsT | 716 | AGAUUGUuAcAcAGuAuACTsT | 717 | AD-14152 | 8% | 5% |
| uAuAcuGuGuAAcAAucuATsT | 718 | uAGAUUGUuAcAcAGuAuATsT | 719 | AD-14153 | 17% | 11% |
| cuuAGuAGuGuccAGGAAATsT | 720 | UUUCCUGGAcACuACuAAGTsT | 721 | AD-14154 | 16% | 4% |
| ucAGAuGGAcGuAAGGcAGTsT | 722 | CUGCCUuACGUCcAUCUGATsT | 723 | AD-14155 | 11% | 1% |
| AGAuAAAuuGAuAGcAcAATsT | 724 | UUGUGCuAUcAAUUuAUCUTsT | 725 | AD-14156 | 10% | 1% |
| cAAcAGGuAcGAcAccAcATsT | 726 | UGUGGUGUCGuACCUGUUGTsT | 727 | AD-14157 | 29% | 3% |
| uGcAAuGuAAAuAcGuAuuTsT | 728 | AAuACGuAUUuAcAUUGcATsT | 729 | AD-14158 | 51% | 3% |
| AGucAGAAuuuuAucuAGATsT | 730 | UCuAGAuAAAAUUCUGACUTsT | 731 | AD-14159 | 53% | 5% |
| cuAGAAucuuuuAAcAccTsT | 732 | GGUGUuAAAAGAUUUCuAGTsT | 733 | AD-14160 | 40% | 3% |
| AAuAAAucuAAcccuAGuuTsT | 734 | AACuAGGGUuAGAUUuAUUTsT | 735 | AD-14161 | 83% | 7% |
| AAuuucuGcucAcGAuGATsT | 736 | UcAUCGUGAGcAGAAAUUTsT | 737 | AD-14162 | 44% | 6% |
| GcccucAGuAAAuccAuGGTsT | 738 | CcAUGGAUUuACUGAGGGCTsT | 739 | AD-14163 | 57% | 3% |

TABLE 3-continued

Sequences and analysis of Eg5/KSP dsRNA duplexes

| Sense sequence (5'-3') | SEQ ID NO. | Antisense sequence (5'-3') | SEQ ID NO. | duplex name | single dose screen @ 25 nM [% residual mRNA] | SDs 2nd screen (among quadruplicates) |
|---|---|---|---|---|---|---|
| AcGuuuAAAAcGAGAucuuTsT | 740 | AAGAUCUCGUUUuAAACGUTsT | 741 | AD-14164 | 4% | 1% |
| AGGAGAuAGAAcGuuuAAATsT | 742 | UUuAAACGUUCuAUCUCCUTsT | 743 | AD-14165 | 11% | 1% |
| GAccGucAuGGcGucGcAGTsT | 744 | CUGCGACGCcAUGACGGUCTsT | 745 | AD-14166 | 90% | 5% |
| AccGucAuGGcGucGcAGcTsT | 746 | GCUGCGACGCcAUGACGGUTsT | 747 | AD-14167 | 49% | 1% |
| GAAcGuuuAAAAcGAGAucTsT | 748 | GAUCUCGUUUuAAACGUUCTsT | 749 | AD-14168 | 12% | 2% |
| uuGAGcuuAAcAuAGGuAATsT | 750 | UuACCuAUGUuAAGCUcAATsT | 751 | AD-14169 | 66% | 4% |
| AcuAAAuuGAucucGuAGATsT | 752 | UCuACGAGAUcAAUUuAGUTsT | 753 | AD-14170 | 52% | 6% |
| ucGuAGAAuuAucuuAAuATsT | 754 | uAUuAAGAuAAUUCuACGATsT | 755 | AD-14171 | 42% | 4% |
| GGAGAuAGAAcGuuuAAAATsT | 756 | UUUuAAACGUUCuAUCUCCTsT | 757 | AD-14172 | 3% | 1% |
| AcAAcuuAuuGGAGGuuGuTsT | 758 | AcAACCUCcAAuAAGUUGUTsT | 759 | AD-14173 | 29% | 2% |
| uGAGcuuAAcAuAGGuAAATsT | 760 | UUuACCuAUGUuAAGCUcATsT | 761 | AD-14174 | 69% | 2% |
| AucucGuAGAAuuAucuuATsT | 762 | uAAGAuAAUUCuACGAGAUTsT | 763 | AD-14175 | 53% | 3% |
| cuGcGuGcAGucGGuccucTsT | 764 | GAGGACCGACUGCACGCAGTsT | 765 | AD-14176 | 111% | 4% |
| cAcGcAGcGcccGAGAGuATsT | 766 | uACUCUCGGGCGCUGCGUGTsT | 767 | AD-14177 | 87% | 6% |
| AGuAccAGGGAGAcuccGGTsT | 768 | CCGGAGUCUCCCUGGuACUTsT | 769 | AD-14178 | 59% | 2% |
| AcGGAGGAGAuAGAAcGuuTsT | 770 | AACGUUCuAUCUCCUCCGUTsT | 771 | AD-14179 | 9% | 2% |
| AGAAcGuuuAAAAcGAGAuTsT | 772 | AUCUCGUUUuAAACGUUCUTsT | 773 | AD-14180 | 43% | 2% |
| AAcGuuuAAAAcGAGAucuTsT | 774 | AGAUCUCGUUUuAAACGUUTsT | 775 | AD-14181 | 70% | 10% |
| AGcuuGAGcuuAAcAuAGGTsT | 776 | CCuAUGUuAAGCUcAAGCUTsT | 777 | AD-14182 | 100% | 7% |
| AGcuuAAcAuAGGuAAAuATsT | 778 | uAUUuACCuAUGUuAAGCUTsT | 779 | AD-14183 | 60% | 5% |
| uAGcuAcAAAAccuAucTsT | 780 | GAuAGGUUUUGuAGCUCuATsT | 781 | AD-14184 | 129% | 6% |
| uAGuuGuAucccuccuuuATsT | 782 | uAAAGGAGGGAuAcAACuATsT | 783 | AD-14185 | 62% | 4% |
| AccAcccAGAcAucuGAcuTsT | 784 | AGUcAGAUGUCUGGGUGGUTsT | 785 | AD-14186 | 42% | 3% |
| AGAAAcuAAAuuGAucucGTsT | 786 | CGAGAUcAAUUuAGUUUCUTsT | 787 | AD-14187 | 123% | 12% |
| ucucGuAGAAuuAucuuAATsT | 788 | UuAAGAuAAUUCuACGAGATsT | 789 | AD-14188 | 38% | 2% |
| cAAcuuAuuGGAGGuuGuATsT | 790 | uAcAACCUCcAAuAAGUUGTsT | 791 | AD-14189 | 13% | 1% |
| uuGuAucccuccuuuAAGuTsT | 792 | ACUuAAAGGAGGGAuAcAATsT | 793 | AD-14190 | 59% | 3% |
| ucAcAAcuuAuuGGAGGuuTsT | 794 | AACCUCcAAuAAGUUGUGATsT | 795 | AD-14191 | 93% | 3% |
| AGAAcuGuAcucuucucAGTsT | 796 | CUGAGAAGAGuAcAGUUCUTsT | 797 | AD-14192 | 45% | 5% |
| GAGcuuAAcAuAGGuAAAuTsT | 798 | AUUuACCuAUGUuAAGCUCTsT | 799 | AD-14193 | 57% | 3% |
| cAccAAcucuGuccuuAGTsT | 800 | CuAAGGAcAGAUGUUGGUGTsT | 801 | AD-14194 | 51% | 4% |
| AAAGcccAcuuuAGAGuAuTsT | 802 | AuACUCuAAAGUGGGCUUUTsT | 803 | AD-14195 | 77% | 5% |
| AAGcccAcuuuAGAGuAuATsT | 804 | uAuACUCuAAAGUGGGCUUTsT | 805 | AD-14196 | 42% | 6% |
| GAccuuAuuuGGuAAucuGTsT | 806 | cAGAUuACcAAAuAAGGUCTsT | 807 | AD-14197 | 15% | 2% |
| GAuuAAuGuAcucAAGAcuTsT | 808 | AGUCUUGAGuAcAUuAAUCTsT | 809 | AD-14198 | 12% | 2% |

TABLE 3-continued

Sequences and analysis of Eg5/KSP dsRNA duplexes

| Sense sequence (5'-3') | SEQ ID NO. | Antisense sequence (5'-3') | SEQ ID NO. | duplex name | single dose screen @ 25 nM [% residual mRNA] | SDs 2nd screen (among quadruplicates) |
|---|---|---|---|---|---|---|
| cuuuAAGAGGccuAAcucATsT | 810 | UGAGUuAGGCCUCUuAAAGTsT | 811 | AD-14199 | 18% | 2% |
| uuAAAccAAAcccuAuuGATsT | 812 | UcAAuAGGGUUUGGUUuAATsT | 813 | AD-14200 | 72% | 9% |
| ucuGuuGGAGAucuAuAAuTsT | 814 | AUuAuAGAUCUCcAAcAGATsT | 815 | AD-14201 | 9% | 3% |
| cuGAuGuuucuGAGAGAcuTsT | 816 | AGUCUCUcAGAAAcAUcAGTsT | 817 | AD-14202 | 25% | 3% |
| GcAuAcucuAGucGuucccTsT | 818 | GGGAACGACuAGAGuAUGCTsT | 819 | AD-14203 | 21% | 1% |
| GuuccuuAucGAGAAucuATsT | 820 | uAGAUUCUCGAuAAGGAACTsT | 821 | AD-14204 | 4% | 2% |
| GcAcuuGGAucucucAcAuTsT | 822 | AUGUGAGAGAUCcAAGUGCTsT | 823 | AD-14205 | 5% | 1% |
| AAAAAAGGAAcuAGAuGGcTsT | 824 | GCcAUCuAGUUCCUUUUUUTsT | 825 | AD-14206 | 79% | 6% |
| AGAGcAGAuuAccucuGcGTsT | 826 | CGcAGAGGuAAUCUGCUCUTsT | 827 | AD-14207 | 55% | 2% |
| AGcAGAuuAccucuGcGAGTsT | 828 | CUCGcAGAGGuAAUCUGCUTsT | 829 | AD-14208 | 100% | 4% |
| cccuGAcAGAGuucAcAAATsT | 830 | UUUGUGAACUCUGUcAGGGTsT | 831 | AD-14209 | 34% | 3% |
| GuuuAccGAAGuGuuGuuuTsT | 832 | AAAcAAcACUUCGGuAAACTsT | 833 | AD-14210 | 13% | 2% |
| uuAcAGuAcAcAAcAAGGATsT | 834 | UCCUUGUUGUGuACGuAATsT | 835 | AD-14211 | 9% | 1% |
| AcuGGAucGuAAGAAGGcATsT | 836 | UGCCUUCUuACGAUCcAGUTsT | 837 | AD-14212 | 20% | 3% |
| GAGcAGAuuAccucuGcGATsT | 838 | UCGcAGAGGuAAUCUGCUCTsT | 839 | AD-14213 | 48% | 5% |
| AAAAGAAGuuAGuGuAcGATsT | 840 | UCGuAcACuAACUUCUUUUTsT | 841 | AD-14214 | 28% | 18% |
| GAccAuuuAAuuuGGcAGATsT | 842 | UCUGCcAAAUuAAAUGGUCTsT | 843 | AD-14215 | 132% | 0% |
| GAGAGGAGuGAuAAuuAAATsT | 844 | UUuAAUuAUcACUCCUCUCTsT | 845 | AD-14216 | 3% | 0% |
| cuGGAGGAuuGGcuGAcAATsT | 846 | UUGUcAGCcAAUCCUCcAGTsT | 847 | AD-14217 | 19% | 1% |
| cucuAGucGuucccAcucATsT | 848 | UGAGUGGGAACGACuAGAGTsT | 849 | AD-14218 | 67% | 8% |
| GAuAccAuuAcAcAGuAGTsT | 850 | CuACUGuAGuAAUGGuAUCTsT | 851 | AD-14219 | 76% | 4% |
| uucGucuGcGAAGAAGAAATsT | 852 | UUUCUUCUUCGcAGACGAATsT | 853 | AD-14220 | 33% | 8% |
| GAAAGAAGuuAGuGuAcGTsT | 854 | CGuAcACuAACUUCUUUUCTsT | 855 | AD-14221 | 25% | 2% |
| uGAuGuuuAccGAAGuGuuTsT | 856 | AAcACUUCGGuAAAcAUcATsT | 857 | AD-14222 | 7% | 2% |
| uGuuuGuccAAuucuGGAuTsT | 858 | AUCcAGAAUUGGAcAAAcATsT | 859 | AD-14223 | 19% | 2% |
| AuGAAGAGuAuAccGGGATsT | 860 | UCCcAGGuAuACUCUUcAUTsT | 861 | AD-14224 | 13% | 1% |
| GcuAcucuGAuGAAuGcAuTsT | 862 | AUGcAUUcAUcAGAGuAGCTsT | 863 | AD-14225 | 15% | 2% |
| GcccuuGuAGAAAGAAcAcTsT | 864 | GUGUUCUUUCuAcAAGGGCTsT | 865 | AD-14226 | 11% | 0% |
| ucAuGuuccuuAucGAGAATsT | 866 | UUCUCGAuAAGGAAcAUGATsT | 867 | AD-14227 | 5% | 1% |
| GAAuAGGGuuAcAGAGuuGTsT | 868 | cAACUCUGuAACCCuAUUCTsT | 869 | AD-14228 | 34% | 3% |
| cAAAcuGGAucGuAAGAAGTsT | 870 | CUUCUuACGAUCcAGUUUGTsT | 871 | AD-14229 | 15% | 2% |
| cuuAuuuGGuAAucuGcuGTsT | 872 | cAGcAGAUuACcAAAuAAGTsT | 873 | AD-14230 | 20% | 1% |
| AGcAAuGuGGAAAccuAAcTsT | 874 | GUuAGGUUUCcAcAUUGCUTsT | 875 | AD-14231 | 18% | 1% |
| AcAAuAAAGcAGAcccAuuTsT | 876 | AAUGGGUCUGCUUuAUUGUTsT | 877 | AD-14232 | 21% | 1% |
| AAccAcuuAGuAGuGuccATsT | 878 | UGGAcACuACuAAGUGGUUTsT | 879 | AD-14233 | 106% | 12% |

TABLE 3-continued

Sequences and analysis of Eg5/KSP dsRNA duplexes

| Sense sequence (5'-3') | SEQ ID NO. | Antisense sequence (5'-3') | SEQ ID NO. | duplex name | single dose screen @ 25 nM [% residual mRNA] | SDs 2nd screen (among quadruplicates) |
|---|---|---|---|---|---|---|
| AGucAAGAGccAucuGuAGTsT | 880 | CuAcAGAUGGCUCUUGACUTsT | 881 | AD-14234 | 35% | 3% |
| cucccuAGAcuucccuAuuTsT | 882 | AAuAGGGAAGUCuAGGGAGTsT | 883 | AD-14235 | 48% | 4% |
| AuAGcuAAAuuAAAccAAATsT | 884 | UUUGGUUuAAUUuAGCuAUTsT | 885 | AD-14236 | 23% | 3% |
| uGGcuGGuAuAAuuccAcGTsT | 886 | CGUGGAAUuAuACcAGCcATsT | 887 | AD-14237 | 79% | 9% |
| uuAuuuGGuAAucuGcuGuTsT | 888 | AcAGcAGAUuACcAAAuAATsT | 889 | AD-14238 | 92% | 7% |
| AAcuAGAuGGcuuucucAGTsT | 890 | CUGAGAAAGCcAUCuAGUUTsT | 891 | AD-14239 | 20% | 2% |
| ucAuGGcGucGcAGccAAATsT | 892 | UUUGGCUGCGACGCcAUGATsT | 893 | AD-14240 | 71% | 6% |
| AcuGGAGGAuuGGcuGAcATsT | 894 | UGUcAGCcAAUCCUCcAGUTsT | 895 | AD-14241 | 14% | 1% |
| cuAuAAuuGcAcuAucuuuTsT | 896 | AAAGAuAGUGcAAUuAuAGTsT | 897 | AD-14242 | 11% | 2% |
| AAAGGucAccuAAuGAAGATsT | 898 | UCUUcAUuAGGUGACCUUUTsT | 899 | AD-14243 | 11% | 1% |
| AuGAAuGcAuAcucuAGucTsT | 900 | GACuAGAGuAUGcAUUcAUTsT | 901 | AD-14244 | 15% | 2% |
| AAcAuAuuGAAuAAGccuGTsT | 902 | cAGGCUuAUUcAAuAUGUUTsT | 903 | AD-14245 | 50% | 7% |
| AAGAAGGcAGuuGAccAAcTsT | 904 | GUUGGUcAACUGCCUUCUUTsT | 905 | AD-14246 | 57% | 5% |
| GAuAcuAAAAGAAcAAucATsT | 906 | UGAUUGUUCUUUuAGuAUCTsT | 907 | AD-14247 | 9% | 3% |
| AuAcuGAAAAucAAuAGucTsT | 908 | GACuAUUGAUUUUcAGuAUTsT | 909 | AD-14248 | 39% | 4% |
| AAAAAGGAAcuAGAuGGcuTsT | 910 | AGCcAUCuAGUUCCUUUUUTsT | 911 | AD-14249 | 64% | 2% |
| GAAcuAGAuGGcuuucucATsT | 912 | UGAGAAAGCcAUCuAGUUCTsT | 913 | AD-14250 | 18% | 2% |
| GAAAccuAAcuGAAGAccuTsT | 914 | AGGUCUUCAGUuAGGUUUCTsT | 915 | AD-14251 | 56% | 6% |
| uAcccAucAAcAcuGGuAATsT | 916 | UuACcAGUGUUGAUGGGuATsT | 917 | AD-14252 | 48% | 6% |
| AuuuuGAuAucuAcccAuuTsT | 918 | AAUGGGuAGAuAUcAAAAUTsT | 919 | AD-14253 | 39% | 5% |
| AucccuAuGuucAcuuuGTsT | 920 | cAAAGUGAACuAuAGGGAUTsT | 921 | AD-14254 | 44% | 8% |
| AuGGGcuAuAAuuGcAcuATsT | 922 | uAGUGcAAUuAuAGCCcAUTsT | 923 | AD-14255 | 108% | 8% |
| AGAuuAccucuGcGAGcccTsT | 924 | GGGCUCGcAGAGGuAAUCUTsT | 925 | AD-14256 | 108% | 6% |
| uAAuccAcGuAcccuucATsT | 926 | UGAAGGGuACGUGGAAUuATsT | 927 | AD-14257 | 23% | 2% |
| GucGuucccAcucAGuuuuTsT | 928 | AAAACuGAGuGGGAACGACTsT | 929 | AD-14258 | 21% | 3% |
| AAAucAAucccuGuuGAcuTsT | 930 | AGUcAAcAGGGAUUGAUUUTsT | 931 | AD-14259 | 19% | 2% |
| ucAuAGAGcAAAGAAcAuATsT | 932 | uAUGUUCUUUGCUCuAUGATsT | 933 | AD-14260 | 10% | 1% |
| uuAcuAcAGuAGcAcuuGGTsT | 934 | CcAAGUGCuACUGuAGuAATsT | 935 | AD-14261 | 76% | 3% |
| AuGuGGAAAccuAAcuGAATsT | 936 | UUcAGUuAGGUUUCcAcAUTsT | 937 | AD-14262 | 13% | 2% |
| uGuGGAAAccuAAcuGAAGTsT | 938 | CUUcAGUuAGGUUUCcAcATsT | 939 | AD-14263 | 14% | 2% |
| ucuuccuuAAAuGAAAGGGTsT | 940 | CCCUUUcAUUuAAGGAAGATsT | 941 | AD-14264 | 65% | 3% |
| uGAAGAAccucuAAGucAATsT | 942 | UUGACUuAGAGGUUCUUcATsT | 943 | AD-14265 | 13% | 1% |
| AGAGGucuAAAGuGGAAGATsT | 944 | UCUUCcACUUuAGACCUCUTsT | 945 | AD-14266 | 18% | 3% |
| AuAucuAcccAuuuuucuGTsT | 946 | cAGAAAAAUGGGuAGAuAUTsT | 947 | AD-14267 | 50% | 9% |
| uAAGccuGAAGuGAAucAGTsT | 948 | CUGAUUcACUUcAGGCUuATsT | 949 | AD-14268 | 13% | 3% |

TABLE 3-continued

Sequences and analysis of Eg5/KSP dsRNA duplexes

| Sense sequence (5'-3') | SEQ ID NO. | Antisense sequence (5'-3') | SEQ ID NO. | duplex name | single dose screen @ 25 nM [% residual mRNA] | SDs 2nd screen (among quadru- plicates) |
|---|---|---|---|---|---|---|
| AGAuGcAGAccAuuuAAuuTsT | 950 | AAUuAAAUGGUCUGcAUCUTsT | 951 | AD-14269 | 19% | 4% |
| AGuGuuGuuuGuccAAuucTsT | 952 | GAAUUGGAcAAAcAACACUTsT | 953 | AD-14270 | 11% | 2% |
| cuAuAAuGAAGAGcuuuuuTsT | 954 | AAAAAGCUCUUcAUuAuAGTsT | 955 | AD-14271 | 11% | 1% |
| AGAGGAGuGAuAAuuAAAGTsT | 956 | CUUuAAUuAUcACUCCUCUTsT | 957 | AD-14272 | 7% | 1% |
| uuucucuGuuAcAAuAcAuTsT | 958 | AUGuAUUGuAAcAGAGAAATsT | 959 | AD-14273 | 14% | 2% |
| AAcAucuAuAAuuGcAAcATsT | 960 | UGUUGcAAUuAuAGAUGUUTsT | 961 | AD-14274 | 73% | 4% |
| uGcuAGAAGuAcAuAAGAcTsT | 962 | GUCUuAUGuACUUCuAGcATsT | 963 | AD-14275 | 10% | 1% |
| AAuGuAcucAAGAcuGAucTsT | 964 | GAUcAGUCUUGAGuAcAUUTsT | 965 | AD-14276 | 89% | 2% |
| GuAcucAAGAcuGAucuucTsT | 966 | GAAGAUcAGUCUUGAGuACTsT | 967 | AD-14277 | 7% | 1% |
| cAcucuGAuAAAcucAAuGTsT | 968 | cAUUGAGUUuAUcAGAGUGTsT | 969 | AD-14278 | 12% | 1% |
| AAGAGcAGAuuAccucuGcTsT | 970 | GcAGAGGuAAUCUGCUCUUTsT | 971 | AD-14279 | 104% | 3% |
| ucuGcGAGcccAGAucAAcTsT | 972 | GUUGAUCUGGGCUCGcAGATsT | 973 | AD-14280 | 21% | 2% |
| AAcuuGAGccuuGuGuAuATsT | 974 | uAuAcAcAAGGCUcAAGUUTsT | 975 | AD-14281 | 43% | 3% |
| GAAuAuAuAucAGccGGTsT | 976 | CCGGCUGAuAuAuAuAUUCTsT | 977 | AD-14282 | 45% | 6% |
| uGucAucccuAuAGuucAcTsT | 978 | GUGAACuAuAGGGAUGAcATsT | 979 | AD-14283 | 35% | 5% |
| GAucuGGcAAccAuAuuucTsT | 980 | GAAAuAUGGUUGCcAGAUCTsT | 981 | AD-14284 | 58% | 3% |
| uGGcAAccAuAuuucuGGATsT | 982 | UCcAGAAAuAUGGUUGCcATsT | 983 | AD-14285 | 48% | 3% |
| GAuGuuuAccGAAGuGuuGTsT | 984 | cAAcACUUCGGuAAAcAUCTsT | 985 | AD-14286 | 49% | 3% |
| uuccuuAucGAGAAucuAATsT | 986 | UuAGAUUCUCGAuAAGGAATsT | 987 | AD-14287 | 6% | 1% |
| AGcuuAAuuGcuuucuGGATsT | 988 | UCcAGAAAGcAAUuAAGCUTsT | 989 | AD-14288 | 50% | 2% |
| uuGcuAuuAuGGGAGAccATsT | 990 | UGGUCUCCcAuAAuAGcAATsT | 991 | AD-14289 | 48% | 1% |
| GucAuGGcGucGcAGccAATsT | 992 | UUGGCUGCGACGCcAUGACTsT | 993 | AD-14290 | 112% | 7% |
| uAAuuGcAcuAucuuuGcGTsT | 994 | CGcAAAGAuAGUGcAAUuATsT | 995 | AD-14291 | 77% | 2% |
| cuAucuuuGcGAuGGccATsT | 996 | UGGCcAuACGcAAAGAuAGTsT | 997 | AD-14292 | 80% | 6% |
| ucccuAuAGuucAcuuuGuTsT | 998 | AcAAAGUGAAcuAuAGGGATsT | 999 | AD-14293 | 58% | 2% |
| ucAAccuuuAAuucAcuuGTsT | 1000 | cAAGUGAAUuAAAGGUUGATsT | 1001 | AD-14294 | 77% | 2% |
| GGcAAccAuAuuucuGGAATsT | 1002 | UUCcAGAAAuAUGGUUGCCTsT | 1003 | AD-14295 | 62% | 2% |
| AuGuAcucAAGAcuGAucuTsT | 1004 | AGAUcAGUCUUGAGuAcAUTsT | 1005 | AD-14296 | 59% | 4% |
| GcAGAccAuuuAAuuuGGcTsT | 1006 | GCcAAAUuAAAUGGUCUGCTsT | 1007 | AD-14297 | 37% | 1% |
| ucuGAGAGAcuAcAGAuGuTsT | 1008 | AcAUCUGuAGUCUCucAGATsT | 1009 | AD-14298 | 21% | 1% |
| uGcucAuAGAGcAAAGAAcTsT | 1010 | GUUCUUUGCUCuAUGAGcATsT | 1011 | AD-14299 | 6% | 1% |
| AcAuAAGAccuuAuuuGGuTsT | 1012 | ACcAAAuAAGGUCUuAUGUTsT | 1013 | AD-14300 | 17% | 2% |
| uuuGcucAuuucuGAuGGTsT | 1014 | CcAUcAGAAAUcAGcAcAAATsT | 1015 | AD-14301 | 97% | 6% |
| ccAucAAcAcuGGuAAGAATsT | 1016 | UUCUuACcAGUGUUGAUGGTsT | 1017 | AD-14302 | 13% | 1% |
| AGAcAAuuccGGAuGuGGATsT | 1018 | UCcAcAUCCGGAAUUGUCUTsT | 1019 | AD-14303 | 13% | 3% |

TABLE 3-continued

Sequences and analysis of Eg5/KSP dsRNA duplexes

| Sense sequence (5'-3') | SEQ ID NO. | Antisense sequence (5'-3') | SEQ ID NO. | duplex name | single dose screen @ 25 nM [% residual mRNA] | SDs 2nd screen (among quadruplicates) |
|---|---|---|---|---|---|---|
| GAAcuuGAGccuuGuGuAuTsT | 1020 | AuAcAcAAGGCUcAAGUUCTsT | 1021 | AD-14304 | 38% | 2% |
| uAAuuuGGcAGAGcGGAAATsT | 1022 | UUUCCGCUCUGCcAAAUuATsT | 1023 | AD-14305 | 14% | 2% |
| uGGAuGAAGuuAuuAuGGGTsT | 1024 | CCcAuAAuAACUUcAUCcATsT | 1025 | AD-14306 | 22% | 4% |
| AucuAcAuGAAcuAcAAGATsT | 1026 | UCUUGuAGUUcAUGuAGAUTsT | 1027 | AD-14307 | 26% | 6% |
| GGuAuuuuGAucuGGcAATsT | 1028 | UUGCcAGAUcAAAAAuACCTsT | 1029 | AD-14308 | 62% | 8% |
| cuAAuGAAGAGuAuAccuGTsT | 1030 | cAGGuAuACUCUUcAUuAGTsT | 1031 | AD-14309 | 52% | 5% |
| uuuGAGAAAcuuAcuGAuATsT | 1032 | uAUcAGuAAGUUUCUcAAATsT | 1033 | AD-14310 | 32% | 3% |
| cGAuAAGAuAGAAGAucAATsT | 1034 | UUGAUCUUCuAUCUuAUCGTsT | 1035 | AD-14311 | 23% | 2% |
| cuGGcAAccAuAuuucuGGTsT | 1036 | CcAGAAAuAUGGUUGCcAGTsT | 1037 | AD-14312 | 49% | 6% |
| uAGAuAccAuuAcuAcAGuTsT | 1038 | ACUGuAGuAAUGGuAUCuATsT | 1039 | AD-14313 | 69% | 4% |
| GuAuuAAAuuGGGuuucAuTsT | 1040 | AUGAAACCcAAUUuAAuACTsT | 1041 | AD-14314 | 52% | 3% |
| AAGAccuuAuuuGGuAAucTsT | 1042 | GAUuACcAAAuAAGGUCUUTsT | 1043 | AD-14315 | 66% | 4% |
| GcuGuuGAuAAGAGAGcucTsT | 1044 | GAGCUCUCUuAUcAAcAGCTsT | 1045 | AD-14316 | 19% | 4% |
| uAcucAuGuuucucAGAuuTsT | 1046 | AAUCUGAGAAAcAUGAGuATsT | 1047 | AD-14317 | 16% | 5% |
| cAGAuGGAcGuAAGGcAGcTsT | 1048 | GCUGCCUuACGUCcAUCUGTsT | 1049 | AD-14318 | 52% | 11% |
| uAucccAAcAGGuAcGAcATsT | 1050 | UGUCGuACCUGUUGGGAuATsT | 1051 | AD-14319 | 28% | 11% |
| cAuuGcuAuuAuGGGAGAcTsT | 1052 | GUCUCCcAuAuAGcAAUGTsT | 1053 | AD-14320 | 52% | 10% |
| cccucAGuAAAuccAuGGuTsT | 1054 | ACcAUGGAUUuACUGAGGGTsT | 1055 | AD-14321 | 53% | 6% |
| GGucAuuAcuGcccuuGATsT | 1056 | uAcAAGGGcAGuAAUGACCTsT | 1057 | AD-14322 | 20% | 2% |
| AAccAcucAAAAAcAuuuGTsT | 1058 | cAAAUGUUUUUGAGUGGUUTsT | 1059 | AD-14323 | 116% | 6% |
| uuuGcAAGuuAAuGAAucuTsT | 1060 | AGAUUcAUuAACUUGcAAATsT | 1061 | AD-14324 | 14% | 2% |
| uuAuuuucAGuAGucAGAATsT | 1062 | UUCUGACuACUGAAAAuAATsT | 1063 | AD-14325 | 50% | 2% |
| uuuucucGAuucAAAucuuTsT | 1064 | AAGAUUuGAAUCGAGAAAATsT | 1065 | AD-14326 | 47% | 3% |
| GuAcGAAAAGAAGuuAGuGTsT | 1066 | cACuAACUUCUUUUCGuACTsT | 1067 | AD-14327 | 18% | 2% |
| uuuAAAAcGAGAucuuGcuTsT | 1068 | AGcAAGAUCUCGUUUuAAATsT | 1069 | AD-14328 | 19% | 1% |
| GAAuuGAuuAAuGuAcucATsT | 1070 | UGAGuAcAUuAAUcAAUUCTsT | 1071 | AD-14329 | 94% | 10% |
| GAuGGAcGuAAGGcAGcucTsT | 1072 | GAGCUGCCUuACGUCcAUCTsT | 1073 | AD-14330 | 60% | 4% |
| cAucuGAcuAAuGGcucuGTsT | 1074 | cAGAGCcAUuAGUcAGAUGTsT | 1075 | AD-14331 | 54% | 7% |
| GuGAuccuGuAcGAAAAGATsT | 1076 | UCUUUUCGuAcAGGAUcACTsT | 1077 | AD-14332 | 22% | 4% |
| AGcucuuAuuAAGGAGuAuTsT | 1078 | AuACUCCUuAAuAAGAGCUTsT | 1079 | AD-14333 | 70% | 10% |
| GcucuuAuuAAGGAGuAuATsT | 1080 | uAuACUCCUuAAuAAGAGCTsT | 1081 | AD-14334 | 18% | 3% |
| ucuuAuuAAGGAGuAuAcGTsT | 1082 | CGuAuACUCCUuAAuAAGATsT | 1083 | AD-14335 | 38% | 6% |
| uAuuAAGGAGuAuAcGGATsT | 1084 | CUCCGuAuACUCCUuAAuATsT | 1085 | AD-14336 | 16% | 3% |
| cuGcAGcccGuGAGAAAAATsT | 1086 | UUUUUCUcACGGGCUGcAGTsT | 1087 | AD-14337 | 65% | 4% |
| ucAAGAcuGAucuucuAAGTsT | 1088 | CUuAGAAGAUcAGUCUUGATsT | 1089 | AD-14338 | 18% | 0% |

TABLE 3-continued

Sequences and analysis of Eg5/KSP dsRNA duplexes

| Sense sequence (5'-3') | SEQ ID NO. | Antisense sequence (5'-3') | SEQ ID NO. | duplex name | single dose screen @ 25 nM [% residual mRNA] | SDs 2nd screen (among quadru-plicates) |
|---|---|---|---|---|---|---|
| cuucuAAGuucAcuGGAAATsT | 1090 | UUUCcAGUGAACUuAGAAGTsT | 1091 | AD-14339 | 20% | 4% |
| uGcAAGuuAAuGAAucuuuTsT | 1092 | AAAGAUUcAUuAACUUGcATsT | 1093 | AD-14340 | 24% | 1% |
| AAucuAAGGAuAuAGucAATsT | 1094 | UUGACuAuAUCCUuAGAUUTsT | 1095 | AD-14341 | 27% | 3% |
| AucucuGAAcAcAAGAAcATsT | 1096 | UGUUCUUGUGUUcAGAGAUTsT | 1097 | AD-14342 | 13% | 1% |
| uucuGAAcAGuGGGuAucuTsT | 1098 | AGAuACCcACUGUUcAGAATsT | 1099 | AD-14343 | 19% | 1% |
| AGuuAuuuAuAcccAucAATsT | 1100 | UUGAUGGGuAuAAAuAACUTsT | 1101 | AD-14344 | 23% | 2% |
| AuGcuAAAcuGuucAGAAATsT | 1102 | UUUCUGAAcAGUUuAGcAUTsT | 1103 | AD-14345 | 21% | 4% |
| cuAcAGAGcAcuuGGuuAcTsT | 1104 | GuAACcAAGUGCUCUGuAGTsT | 1105 | AD-14346 | 18% | 2% |
| uAuAucAGccGGGcGcGTsT | 1106 | CGCGCCCGGCUGAuAuAuATsT | 1107 | AD-14347 | 67% | 2% |
| AuGuAAAuAcGuAuuucuATsT | 1108 | uAGAAAuACGuAUUuAcAUTsT | 1109 | AD-14348 | 39% | 3% |
| uuuuucucGAuucAAAucuTsT | 1110 | AGAUUuGAAUCGAGAAAAATsT | 1111 | AD-14349 | 83% | 6% |
| AAucuuAAcccuuAGGAcuTsT | 1112 | AGUCCuAAGGGUuAAGAUUTsT | 1113 | AD-14350 | 54% | 2% |
| ccuuAGGAcucuGGuAuuuTsT | 1114 | AAAuAccAGAGUCCuAAGGTsT | 1115 | AD-14351 | 57% | 8% |
| AAuAAAcuGcccucAGuAATsT | 1116 | UuACUGAGGGcAGUuAUUTsT | 1117 | AD-14352 | 82% | 3% |
| GAuccuGuAcGAAAAGAAGTsT | 1118 | CUUCUUUUCGuAcAGGAUCTsT | 1119 | AD-14353 | 2% | 1% |
| AAuGuGAuccuGuAcGAAATsT | 1120 | UUUCGuAcAGGAUcAcAUUTsT | 1121 | AD-14354 | 18% | 11% |
| GuGAAAcAuuGGccGuucTsT | 1122 | GAACGGCcAAUGUUUuCACTsT | 1123 | AD-14355 | 2% | 1% |
| cuuGAGGAAAcucuGAGuATsT | 1124 | uACUcAGAGUUUCCUcAAGTsT | 1125 | AD-14356 | 8% | 2% |
| cGuuuAAAAcGAGAucuuGTsT | 1126 | cAAGAUCUCGUUUuAAACGTsT | 1127 | AD-14357 | 6% | 3% |
| uuAAAAcGAGAucuuGcuGTsT | 1128 | cAGcAAGAUCUCGUUUuAATsT | 1129 | AD-14358 | 98% | 17% |
| AAAGAuGuAucGGucuccTsT | 1130 | GGAGACcAGAuAcAUCUUUTsT | 1131 | AD-14359 | 10% | 1% |
| cAGAAAAuGuGucuAcucATsT | 1132 | UGAGuAGAcAcAUUUUCUGTsT | 1133 | AD-14360 | 6% | 4% |
| cAGGAAuuGAuuAAuGuAcTsT | 1134 | GuAcAUuAAUcAAUUCCUGTsT | 1135 | AD-14361 | 30% | 5% |
| AGucAAcuAAAGcAuAuuuTsT | 1136 | AAAuAUGCUUuAGUUGACUTsT | 1137 | AD-14362 | 28% | 2% |
| uGuGuAAcAAucuAcAuGATsT | 1138 | UcAUGuAGAUUGUuAcAcATsT | 1139 | AD-14363 | 60% | 6% |
| AuAccAuuuGuuccuuGGuTsT | 1140 | ACcAAGGAAcAAAUGGuAUTsT | 1141 | AD-14364 | 12% | 9% |
| GcAGAAAucuAAGGAuAuATsT | 1142 | uAuAUCCUuAGAUUUCUGCTsT | 1143 | AD-14365 | 5% | 2% |
| uGGcuucucAcAGGAAcucTsT | 1144 | GAGUUCCUGUGAGAAGCcATsT | 1145 | AD-14366 | 28% | 5% |
| GAGAuGuGAAucucuGAAcTsT | 1146 | GUUcAGAGAUUcAcAUCUCTsT | 1147 | AD-14367 | 42% | 4% |
| uGuAAGccAAuGuuGuGAGTsT | 1148 | CUcAcAAcAUUGGCUuAcATsT | 1149 | AD-14368 | 93% | 12% |
| AGccAAuGuuGuGAGGcuuTsT | 1150 | AAGCCUcAcAAcAUUGGCUTsT | 1151 | AD-14369 | 65% | 4% |
| uuGuGAGGcuucAAGuucATsT | 1152 | UGAACUUGAAGCCUcAcAATsT | 1153 | AD-14370 | 5% | 2% |
| AGGcAGcucAuGAGAAAcATsT | 1154 | UGUUUCUcAUGAGCUGCCUTsT | 1155 | AD-14371 | 54% | 5% |
| AuAAAuuGAuAGcAcAAAATsT | 1156 | UUUUGUGCuAUcAAUUuAUTsT | 1157 | AD-14372 | 4% | 1% |
| AcAAAucuAGAAcuuAAuTsT | 1158 | AUuAAGUUCuAGAUUUUGUTsT | 1159 | AD-14373 | 5% | 1% |

TABLE 3-continued

Sequences and analysis of Eg5/KSP dsRNA duplexes

| Sense sequence (5'-3') | SEQ ID NO. | Antisense sequence (5'-3') | SEQ ID NO. | duplex name | single dose screen @ 25 nM [% residual mRNA] | SDs 2nd screen (among quadruplicates) |
|---|---|---|---|---|---|---|
| GAuAucccAAcAGGuAcGATsT | 1160 | UCGuACCUGUUGGGAuAUCTsT | 1161 | AD-14374 | 92% | 6% |
| AAGuuAuuuAuAcccAucATsT | 1162 | UGAUGGGuAuAAAuAACUUTsT | 1163 | AD-14375 | 76% | 4% |
| uGuAAAuAcGuAuuucuAGTsT | 1164 | CuAGAAAuACGuAUUuAcATsT | 1165 | AD-14376 | 70% | 5% |
| ucuAGuuuucAuAuAAAGuTsT | 1166 | ACUUuAuAUGAAAACuAGATsT | 1167 | AD-14377 | 48% | 4% |
| AuAAAGuAGuucuuuuAuATsT | 1168 | uAuAAAAGAACuACUUuAUTsT | 1169 | AD-14378 | 48% | 3% |
| ccAuuuGuAGAGcuAcAAATsT | 1170 | UUUGuAGCUCuAcAAAUGGTsT | 1171 | AD-14379 | 44% | 5% |
| uAuuucAGuAGucAGAAuTsT | 1172 | AUUCUGACuACUGAAAAuATsT | 1173 | AD-14380 | 35% | 16% |
| AAAucuAAccuAGuuGuATsT | 1174 | uAcAACuAGGGUuAGAUUUTsT | 1175 | AD-14381 | 44% | 5% |
| cuuuAGAGuAuAcAuuGcuTsT | 1176 | AGcAAUGuAuACUCuAAAGTsT | 1177 | AD-14382 | 28% | 1% |
| AucuGAcuAAuGGcucuGuTsT | 1178 | AcAGAGCcAUuAGUcAGAUTsT | 1179 | AD-14383 | 55% | 11% |
| cAcAAuGAuuuAAGGAcuGTsT | 1180 | cAGUCCUuAAAUcAUUGUGTsT | 1181 | AD-14384 | 48% | 9% |
| ucuuuuucucGAuucAAAuTsT | 1182 | AUUuGAAUCGAGAAAAAGATsT | 1183 | AD-14385 | 36% | 2% |
| cuuuuucucGAuucAAAucTsT | 1184 | GAUUuGAAUCGAGAAAAAGTsT | 1185 | AD-14386 | 41% | 7% |
| AuuuucuGcucAcGAuGAGTsT | 1186 | CUcAUCGUGAGcAGAAAAUTsT | 1187 | AD-14387 | 38% | 3% |
| uuucuGcucAcGAuGAGuuTsT | 1188 | AACUcAUCGUGAGcAGAAATsT | 1189 | AD-14388 | 50% | 4% |
| AGAGcuAcAAAAccuAuccTsT | 1190 | GGAuAGGUUUUGuAGCUCUTsT | 1191 | AD-14389 | 98% | 6% |
| GAGccAAAGGuAcAccAcuTsT | 1192 | AGUGGUGuACCUUUGGCUCTsT | 1193 | AD-14390 | 43% | 8% |
| GccAAAGGuAcAccAcuAcTsT | 1194 | GuAGUGGUGuACCUUUGGCTsT | 1195 | AD-14391 | 48% | 4% |
| GAAcuGuAcucuucucAGcTsT | 1196 | GCUGAGAAGAGuACAGUUCTsT | 1197 | AD-14392 | 44% | 3% |
| AGGuAAAuAucAccAAcAuTsT | 1198 | AUGUUGGUGAuAUUuACCUTsT | 1199 | AD-14393 | 37% | 2% |
| AGcuAcAAAAccuAuccuuTsT | 1200 | AAGGAuAGGUUUUGuAGCUTsT | 1201 | AD-14394 | 114% | 7% |
| uGuGAAAGcAuuuAAuuccTsT | 1202 | GGAAUuAAAUGCUUUcAcATsT | 1203 | AD-14395 | 55% | 4% |
| GcccAcuuuAGAGuAuAcATsT | 1204 | UGuAuACUCuAAAGUGGGCTsT | 1205 | AD-14396 | 49% | 5% |
| uGuGccAcAcuccAAGAccTsT | 1206 | GGUCUUGGAGUGUGGcAcATsT | 1207 | AD-14397 | 71% | 6% |
| AAAcuAAAuuGAucucGuATsT | 1208 | uACGAGAUcAAUUuAGUUUTsT | 1209 | AD-14398 | 81% | 7% |
| uGAucucGuAGAAuuAucuTsT | 1210 | AGAuAAUUCuACGAGAUcATsT | 1211 | AD-14399 | 38% | 4% |
| GcGuGcAGucGGuccuccATsT | 1212 | UGGAGGACCGACUGcACGCTsT | 1213 | AD-14400 | 106% | 8% |
| AAAGuuuAGAGAcucuGATsT | 1214 | UcAGAUGUCUCuAAACUUUTsT | 1215 | AD-14401 | 47% | 3% |
| cAGAAGGAAuAuGuAcAAATsT | 1216 | UUUGuAcAuAUUCCUUCUGTsT | 1217 | AD-14402 | 31% | 1% |
| cGcccGAGAGuAccAGGGATsT | 1218 | UCCCUGGuACUCUCGGGCGTsT | 1219 | AD-14403 | 105% | 4% |
| cGGAGGAGAuAGAAcGuuuTsT | 1220 | AAACGUUCuAUCUCCUCCGTsT | 1221 | AD-14404 | 3% | 1% |
| AGAuAGAAcGuuuAAAAcGTsT | 1222 | CGUUUuAAACGUUCuAUCUTsT | 1223 | AD-14405 | 15% | 1% |
| GGAAcAGGAAcuucAcAAcTsT | 1224 | GUuGuGAAGUUCCuGUUCCTsT | 1225 | AD-14406 | 44% | 5% |
| GuGAGccAAAGGuAcAccATsT | 1226 | UGGUGuACCUUUGGCUcACTsT | 1227 | AD-14407 | 41% | 4% |
| AuccucccuAGAcuucccuTsT | 1228 | AGGGAAGUCuAGGGAGGAUTsT | 1229 | AD-14408 | 104% | 3% |

TABLE 3-continued

Sequences and analysis of Eg5/KSP dsRNA duplexes

| Sense sequence (5'-3') | SEQ ID NO. | Antisense sequence (5'-3') | SEQ ID NO. | duplex name | single dose screen @ 25 nM [% residual mRNA] | SDs 2nd screen (among quadru-plicates) |
|---|---|---|---|---|---|---|
| cAcAcuccAAGAccuGuGcTsT | 1230 | GcAcAGGUCUUGGAGUGUGTsT | 1231 | AD-14409 | 67% | 4% |
| AcAGAAGGAAuAuGuAcAATsT | 1232 | UUGuAcAuAUUCCUUCUGUTsT | 1233 | AD-14410 | 22% | 1% |
| uuAGAGAcAucuGAcuuuGTsT | 1234 | cAAAGUcAGAUGUCUCuAATsT | 1235 | AD-14411 | 29% | 3% |
| AAuuGAucucGuAGAAuuATsT | 1236 | uAAUUCuACGAGAUcAAUUTsT | 1237 | AD-14412 | 31% | 4% | dsRNA Targeting the VEGF Gene

Four hundred target sequences were identified within exons 1-5 of the VEGF-A121 mRNA sequence. reference transcript is: NM_003376.

(SEQ ID NO: 1539)
```
  1 augaacuuuc ugcugucuug ggugcauugg agccuugccu ugcugcucua ccuccaccau
 61 gccaaguggu cccaggcugc acccauggca gaaggaggag ggcagaauca ucacgaagug
121 gugaaguuca uggaugucua ucagcgcagc uacugccauc caaucgagac ccugguggac
181 aucuuccagg aguacccuga ugagaucgag uacaucuuca agccauccug ugugccccug
241 augcgaugcg ggggcugcug caaugacgag ggccuggagu gugugcccac ugaggaguccc
301 aacaucacca ugcagauuau gcggaucaaa ccucaccaag gccagcacau aggagagaug
361 agcuuccuac agcacaacaa augugaaugc agaccaaaga aagauagagc aagacaagaa
421 aaaugugaca agccgaggcg guga
```

Table 4a includes the identified target sequences. Corresponding siRNAs targeting these sequences were subjected to a bioinformatics screen.

To ensure that the sequences were specific to VEGF sequence and not to sequences from any other genes, the target sequences were checked against the sequences in Genbank using the BLAST search engine provided by NCBI. The use of the BLAST algorithm is described in Altschul et al., J. Mol. Biol. 215:403, 1990; and Altschul and Gish, Meth. Enzymol. 266:460, 1996.

siRNAs were also prioritized for their ability to cross react with monkey, rat and human VEGF sequences.

Of these 400 potential target sequences 80 were selected for analysis by experimental screening in order to identify a small number of lead candidates. A total of 114 siRNA molecules were designed for these 80 target sequences 114 (Table 4b).

TABLE 4a

| Target sequences in VEGF-121 | | |
|---|---|---|
| SEQ ID NO: | position in VEGF-121 ORF | TARGET SEQUENCE IN VEGF121 mRNA 5' to 3' |
| 1540 | 1 | AUGAACUUUCUGCUGUCUUGGGU |
| 1541 | 2 | UGAACUUUCUGCUGUCUUGGGUG |

TABLE 4a-continued

| Target sequences in VEGF-121 | | |
|---|---|---|
| SEQ ID NO: | position in VEGF-121 ORF | TARGET SEQUENCE IN VEGF121 mRNA 5' to 3' |
| 1542 | 3 | GAACUUUCUGCUGUCUUGGGUGC |
| 1543 | 4 | AACUUUCUGCUGUCUUGGGUGCA |
| 1544 | 5 | ACUUUCUGCUGUCUUGGGUGCAU |
| 1545 | 6 | CUUUCUGCUGUCUUGGGUGCAUU |
| 1546 | 7 | UUUCUGCUGUCUUGGGUGCAUUG |
| 1547 | 8 | UUCUGCUGUCUUGGGUGCAUUGG |
| 1548 | 9 | UCUGCUGUCUUGGGUGCAUUGGA |
| 1549 | 10 | CUGCUGUCUUGGGUGCAUUGGAG |
| 1550 | 11 | UGCUGUCUUGGGUGCAUUGGAGC |
| 1551 | 12 | GCUGUCUUGGGUGCAUUGGAGCC |
| 1552 | 13 | CUGUCUUGGGUGCAUUGGAGCCU |
| 1553 | 14 | UGUCUUGGGUGCAUUGGAGCCUU |
| 1554 | 15 | GUCUUGGGUGCAUUGGAGCCUUG |
| 1555 | 16 | UCUUGGGUGCAUUGGAGCCUUGC |

TABLE 4a-continued

Target sequences in VEGF-121

| SEQ ID NO: | position in VEGF-121 ORF | TARGET SEQUENCE IN VEGF121 mRNA 5' to 3' |
|---|---|---|
| 1556 | 17 | CUUGGGUGCAUUGGAGCCUUGCC |
| 1557 | 18 | UUGGGUGCAUUGGAGCCUUGCCU |
| 1558 | 19 | UGGGUGCAUUGGAGCCUUGCCUU |
| 1559 | 20 | GGGUGCAUUGGAGCCUUGCCUUG |
| 1560 | 21 | GGUGCAUUGGAGCCUUGCCUUGC |
| 1561 | 22 | GUGCAUUGGAGCCUUGCCUUGCU |
| 1562 | 23 | UGCAUUGGAGCCUUGCCUUGCUG |
| 1563 | 24 | GCAUUGGAGCCUUGCCUUGCUGC |
| 1564 | 25 | CAUUGGAGCCUUGCCUUGCUGCU |
| 1565 | 26 | AUUGGAGCCUUGCCUUGCUGCUC |
| 1566 | 27 | UUGGAGCCUUGCCUUGCUGCUCU |
| 1567 | 28 | UGGAGCCUUGCCUUGCUGCUCUA |
| 1568 | 29 | GGAGCCUUGCCUUGCUGCUCUAC |
| 1569 | 30 | GAGCCUUGCCUUGCUGCUCUACC |
| 1570 | 31 | AGCCUUGCCUUGCUGCUCUACCU |
| 1571 | 32 | GCCUUGCCUUGCUGCUCUACCUC |
| 1572 | 33 | CCUUGCCUUGCUGCUCUACCUCC |
| 1573 | 34 | CUUGCCUUGCUGCUCUACCUCCA |
| 1574 | 35 | UUGCCUUGCUGCUCUACCUCCAC |
| 1575 | 36 | UGCCUUGCUGCUCUACCUCCACC |
| 1576 | 37 | GCCUUGCUGCUCUACCUCCACCA |
| 1577 | 38 | CCUUGCUGCUCUACCUCCACCAU |
| 1578 | 39 | CUUGCUGCUCUACCUCCACCAUG |
| 1579 | 40 | UUGCUGCUCUACCUCCACCAUGC |
| 1580 | 41 | UGCUGCUCUACCUCCACCAUGCC |
| 1581 | 42 | GCUGCUCUACCUCCACCAUGCCA |
| 1582 | 43 | CUGCUCUACCUCCACCAUGCCAA |
| 1583 | 44 | UGCUCUACCUCCACCAUGCCAAG |
| 1584 | 45 | GCUCUACCUCCACCAUGCCAAGU |
| 1585 | 46 | CUCUACCUCCACCAUGCCAAGUG |
| 1586 | 47 | UCUACCUCCACCAUGCCAAGUGG |
| 1587 | 48 | CUACCUCCACCAUGCCAAGUGGU |
| 1588 | 49 | UACCUCCACCAUGCCAAGUGGUC |
| 1589 | 50 | ACCUCCACCAUGCCAAGUGGUCC |
| 1590 | 51 | CCUCCACCAUGCCAAGUGGUCCC |
| 1591 | 52 | CUCCACCAUGCCAAGUGGUCCCA |
| 1592 | 53 | UCCACCAUGCCAAGUGGUCCCAG |
| 1593 | 54 | CCACCAUGCCAAGUGGUCCCAGG |
| 1594 | 55 | CACCAUGCCAAGUGGUCCCAGGC |
| 1595 | 56 | ACCAUGCCAAGUGGUCCCAGGCU |
| 1596 | 57 | CCAUGCCAAGUGGUCCCAGGCUG |
| 1597 | 58 | CAUGCCAAGUGGUCCCAGGCUGC |
| 1598 | 59 | AUGCCAAGUGGUCCCAGGCUGCA |
| 1599 | 60 | UGCCAAGUGGUCCCAGGCUGCAC |
| 1600 | 61 | GCCAAGUGGUCCCAGGCUGCACC |
| 1601 | 62 | CCAAGUGGUCCCAGGCUGCACCC |
| 1602 | 63 | CAAGUGGUCCCAGGCUGCACCCA |
| 1603 | 64 | AAGUGGUCCCAGGCUGCACCCAU |
| 1604 | 65 | AGUGGUCCCAGGCUGCACCCAUG |
| 1605 | 66 | GUGGUCCCAGGCUGCACCCAUGG |
| 1606 | 67 | UGGUCCCAGGCUGCACCCAUGGC |
| 1607 | 68 | GGUCCCAGGCUGCACCCAUGGCA |
| 1608 | 69 | GUCCCAGGCUGCACCCAUGGCAG |
| 1609 | 70 | UCCCAGGCUGCACCCAUGGCAGA |
| 1610 | 71 | CCCAGGCUGCACCCAUGGCAGAA |
| 1611 | 72 | CCAGGCUGCACCCAUGGCAGAAG |
| 1612 | 73 | CAGGCUGCACCCAUGGCAGAAGG |
| 1613 | 74 | AGGCUGCACCCAUGGCAGAAGGA |
| 1614 | 75 | GGCUGCACCCAUGGCAGAAGGAG |
| 1615 | 76 | GCUGCACCCAUGGCAGAAGGAGG |
| 1616 | 77 | CUGCACCCAUGGCAGAAGGAGGA |
| 1617 | 78 | UGCACCCAUGGCAGAAGGAGGAG |
| 1618 | 79 | GCACCCAUGGCAGAAGGAGGAGG |
| 1619 | 80 | CACCCAUGGCAGAAGGAGGAGGG |
| 1620 | 81 | ACCCAUGGCAGAAGGAGGAGGGC |
| 1621 | 82 | CCCAUGGCAGAAGGAGGAGGGCA |
| 1622 | 83 | CCAUGGCAGAAGGAGGAGGGCAG |
| 1623 | 84 | CAUGGCAGAAGGAGGAGGGCAGA |
| 1624 | 85 | AUGGCAGAAGGAGGAGGGCAGAA |
| 1625 | 86 | UGGCAGAAGGAGGAGGGCAGAAU |
| 1626 | 87 | GGCAGAAGGAGGAGGGCAGAAUC |
| 1627 | 88 | GCAGAAGGAGGAGGGCAGAAUCA |
| 1628 | 89 | CAGAAGGAGGAGGGCAGAAUCAU |
| 1629 | 90 | AGAAGGAGGAGGGCAGAAUCAUC |

TABLE 4a-continued

Target sequences in VEGF-121

| SEQ ID NO: | position in VEGF-121 ORF | TARGET SEQUENCE IN VEGF121 mRNA 5' to 3' |
|---|---|---|
| 1630 | 91 | GAAGGAGGAGGGCAGAAUCAUCA |
| 1631 | 92 | AAGGAGGAGGGCAGAAUCAUCAC |
| 1632 | 93 | AGGAGGAGGGCAGAAUCAUCACG |
| 1633 | 94 | GGAGGAGGGCAGAAUCAUCACGA |
| 1634 | 95 | GAGGAGGGCAGAAUCAUCACGAA |
| 1635 | 96 | AGGAGGGCAGAAUCAUCACGAAG |
| 1636 | 97 | GGAGGGCAGAAUCAUCACGAAGU |
| 1637 | 98 | GAGGGCAGAAUCAUCACGAAGUG |
| 1638 | 99 | AGGGCAGAAUCAUCACGAAGUGG |
| 1639 | 100 | GGGCAGAAUCAUCACGAAGUGGU |
| 1640 | 101 | GGCAGAAUCAUCACGAAGUGGUG |
| 1641 | 102 | GCAGAAUCAUCACGAAGUGGUGA |
| 1642 | 103 | CAGAAUCAUCACGAAGUGGUGAA |
| 1643 | 104 | AGAAUCAUCACGAAGUGGUGAAG |
| 1644 | 105 | GAAUCAUCACGAAGUGGUGAAGU |
| 1645 | 106 | AAUCAUCACGAAGUGGUGAAGUU |
| 1646 | 107 | AUCAUCACGAAGUGGUGAAGUUC |
| 1647 | 108 | UCAUCACGAAGUGGUGAAGUUCA |
| 1648 | 109 | CAUCACGAAGUGGUGAAGUUCAU |
| 1649 | 110 | AUCACGAAGUGGUGAAGUUCAUG |
| 1650 | 111 | UCACGAAGUGGUGAAGUUCAUGG |
| 1651 | 112 | CACGAAGUGGUGAAGUUCAUGGA |
| 1652 | 113 | ACGAAGUGGUGAAGUUCAUGGAU |
| 1653 | 114 | CGAAGUGGUGAAGUUCAUGGAUG |
| 1654 | 115 | GAAGUGGUGAAGUUCAUGGAUGU |
| 1655 | 116 | AAGUGGUGAAGUUCAUGGAUGUC |
| 1656 | 117 | AGUGGUGAAGUUCAUGGAUGUCU |
| 1657 | 118 | GUGGUGAAGUUCAUGGAUGUCUA |
| 1658 | 119 | UGGUGAAGUUCAUGGAUGUCUAU |
| 1659 | 120 | GGUGAAGUUCAUGGAUGUCUAUC |
| 1660 | 121 | GUGAAGUUCAUGGAUGUCUAUCA |
| 1661 | 122 | UGAAGUUCAUGGAUGUCUAUCAG |
| 1662 | 123 | GAAGUUCAUGGAUGUCUAUCAGC |
| 1663 | 124 | AAGUUCAUGGAUGUCUAUCAGCG |
| 1664 | 125 | AGUUCAUGGAUGUCUAUCAGCGC |
| 1665 | 126 | GUUCAUGGAUGUCUAUCAGCGCA |
| 1666 | 127 | UUCAUGGAUGUCUAUCAGCGCAG |
| 1667 | 128 | UCAUGGAUGUCUAUCAGCGCAGC |
| 1668 | 129 | CAUGGAUGUCUAUCAGCGCAGCU |
| 1669 | 130 | AUGGAUGUCUAUCAGCGCAGCUA |
| 1670 | 131 | UGGAUGUCUAUCAGCGCAGCUAC |
| 1671 | 132 | GGAUGUCUAUCAGCGCAGCUACU |
| 1672 | 133 | GAUGUCUAUCAGCGCAGCUACUG |
| 1673 | 134 | AUGUCUAUCAGCGCAGCUACUGC |
| 1674 | 135 | UGUCUAUCAGCGCAGCUACUGCC |
| 1675 | 136 | GUCUAUCAGCGCAGCUACUGCCA |
| 1676 | 137 | UCUAUCAGCGCAGCUACUGCCAU |
| 1677 | 138 | CUAUCAGCGCAGCUACUGCCAUC |
| 1678 | 139 | UAUCAGCGCAGCUACUGCCAUCC |
| 1679 | 140 | AUCAGCGCAGCUACUGCCAUCCA |
| 1680 | 141 | UCAGCGCAGCUACUGCCAUCCAA |
| 1681 | 142 | CAGCGCAGCUACUGCCAUCCAAU |
| 1682 | 143 | AGCGCAGCUACUGCCAUCCAAUC |
| 1683 | 144 | GCGCAGCUACUGCCAUCCAAUCG |
| 1684 | 145 | CGCAGCUACUGCCAUCCAAUCGA |
| 1685 | 146 | GCAGCUACUGCCAUCCAAUCGAG |
| 1686 | 147 | CAGCUACUGCCAUCCAAUCGAGA |
| 1687 | 148 | AGCUACUGCCAUCCAAUCGAGAC |
| 1688 | 149 | GCUACUGCCAUCCAAUCGAGACC |
| 1689 | 150 | CUACUGCCAUCCAAUCGAGACCC |
| 1690 | 151 | UACUGCCAUCCAAUCGAGACCCU |
| 1691 | 152 | ACUGCCAUCCAAUCGAGACCCUG |
| 1692 | 153 | CUGCCAUCCAAUCGAGACCCUGG |
| 1693 | 154 | UGCCAUCCAAUCGAGACCCUGGU |
| 1694 | 155 | GCCAUCCAAUCGAGACCCUGGUG |
| 1695 | 156 | CCAUCCAAUCGAGACCCUGGUGG |
| 1696 | 157 | CAUCCAAUCGAGACCCUGGUGGA |
| 1697 | 158 | AUCCAAUCGAGACCCUGGUGGAC |
| 1698 | 159 | UCCAAUCGAGACCCUGGUGGACA |
| 1699 | 160 | CCAAUCGAGACCCUGGUGGACAU |
| 1700 | 161 | CAAUCGAGACCCUGGUGGACAUC |
| 1701 | 162 | AAUCGAGACCCUGGUGGACAUCU |
| 1702 | 163 | AUCGAGACCCUGGUGGACAUCUU |
| 1703 | 164 | UCGAGACCCUGGUGGACAUCUUC |

TABLE 4a-continued

Target sequences in VEGF-121

| SEQ ID NO: | position in VEGF-121 ORF | TARGET SEQUENCE IN VEGF121 mRNA 5' to 3' |
|---|---|---|
| 1704 | 165 | CGAGACCCUGGUGGACAUCUUCC |
| 1705 | 166 | GAGACCCUGGUGGACAUCUUCCA |
| 1706 | 167 | AGACCCUGGUGGACAUCUUCCAG |
| 1707 | 168 | GACCCUGGUGGACAUCUUCCAGG |
| 1708 | 169 | ACCCUGGUGGACAUCUUCCAGGA |
| 1709 | 170 | CCCUGGUGGACAUCUUCCAGGAG |
| 1710 | 171 | CCUGGUGGACAUCUUCCAGGAGU |
| 1711 | 172 | CUGGUGGACAUCUUCCAGGAGUA |
| 1712 | 173 | UGGUGGACAUCUUCCAGGAGUAC |
| 1713 | 174 | GGUGGACAUCUUCCAGGAGUACC |
| 1714 | 175 | GUGGACAUCUUCCAGGAGUACCC |
| 1715 | 176 | UGGACAUCUUCCAGGAGUACCCU |
| 1716 | 177 | GGACAUCUUCCAGGAGUACCCUG |
| 1717 | 178 | GACAUCUUCCAGGAGUACCCUGA |
| 1718 | 179 | ACAUCUUCCAGGAGUACCCUGAU |
| 1719 | 180 | CAUCUUCCAGGAGUACCCUGAUG |
| 1720 | 181 | AUCUUCCAGGAGUACCCUGAUGA |
| 1721 | 182 | UCUUCCAGGAGUACCCUGAUGAG |
| 1722 | 183 | CUUCCAGGAGUACCCUGAUGAGA |
| 1723 | 184 | UUCCAGGAGUACCCUGAUGAGAU |
| 1724 | 185 | UCCAGGAGUACCCUGAUGAGAUC |
| 1725 | 186 | CCAGGAGUACCCUGAUGAGAUCG |
| 1726 | 187 | CAGGAGUACCCUGAUGAGAUCGA |
| 1727 | 188 | AGGAGUACCCUGAUGAGAUCGAG |
| 1728 | 189 | GGAGUACCCUGAUGAGAUCGAGU |
| 1729 | 190 | GAGUACCCUGAUGAGAUCGAGUA |
| 1730 | 191 | AGUACCCUGAUGAGAUCGAGUAC |
| 1731 | 192 | GUACCCUGAUGAGAUCGAGUACA |
| 1732 | 193 | UACCCUGAUGAGAUCGAGUACAU |
| 1733 | 194 | ACCCUGAUGAGAUCGAGUACAUC |
| 1734 | 195 | CCCUGAUGAGAUCGAGUACAUCU |
| 1735 | 196 | CCUGAUGAGAUCGAGUACAUCUU |
| 1736 | 197 | CUGAUGAGAUCGAGUACAUCUUC |
| 1737 | 198 | UGAUGAGAUCGAGUACAUCUUCA |
| 1738 | 199 | GAUGAGAUCGAGUACAUCUUCAA |
| 1739 | 200 | AUGAGAUCGAGUACAUCUUCAAG |
| 1740 | 201 | UGAGAUCGAGUACAUCUUCAAGC |
| 1741 | 202 | GAGAUCGAGUACAUCUUCAAGCC |
| 1742 | 203 | AGAUCGAGUACAUCUUCAAGCCA |
| 1743 | 204 | GAUCGAGUACAUCUUCAAGCCAU |
| 1744 | 205 | AUCGAGUACAUCUUCAAGCCAUC |
| 1745 | 206 | UCGAGUACAUCUUCAAGCCAUCC |
| 1746 | 207 | CGAGUACAUCUUCAAGCCAUCCU |
| 1747 | 208 | GAGUACAUCUUCAAGCCAUCCUG |
| 1748 | 209 | AGUACAUCUUCAAGCCAUCCUGU |
| 1749 | 210 | GUACAUCUUCAAGCCAUCCUGUG |
| 1750 | 211 | UACAUCUUCAAGCCAUCCUGUGU |
| 1751 | 212 | ACAUCUUCAAGCCAUCCUGUGUG |
| 1752 | 213 | CAUCUUCAAGCCAUCCUGUGUGC |
| 1753 | 214 | AUCUUCAAGCCAUCCUGUGUGCC |
| 1754 | 215 | UCUUCAAGCCAUCCUGUGUGCCC |
| 1755 | 216 | CUUCAAGCCAUCCUGUGUGCCCC |
| 1756 | 217 | UUCAAGCCAUCCUGUGUGCCCCU |
| 1757 | 218 | UCAAGCCAUCCUGUGUGCCCCUG |
| 1758 | 219 | CAAGCCAUCCUGUGUGCCCCUGA |
| 1759 | 220 | AAGCCAUCCUGUGUGCCCCUGAU |
| 1760 | 221 | AGCCAUCCUGUGUGCCCCUGAUG |
| 1761 | 222 | GCCAUCCUGUGUGCCCCUGAUGC |
| 1762 | 223 | CCAUCCUGUGUGCCCCUGAUGCG |
| 1763 | 224 | CAUCCUGUGUGCCCCUGAUGCGA |
| 1764 | 225 | AUCCUGUGUGCCCCUGAUGCGAU |
| 1765 | 226 | UCCUGUGUGCCCCUGAUGCGAUG |
| 1766 | 227 | CCUGUGUGCCCCUGAUGCGAUGC |
| 1767 | 228 | CUGUGUGCCCCUGAUGCGAUGCG |
| 1768 | 229 | UGUGUGCCCCUGAUGCGAUGCGG |
| 1769 | 230 | GUGUGCCCCUGAUGCGAUGCGGG |
| 1770 | 231 | UGUGCCCCUGAUGCGAUGCGGGG |
| 1771 | 232 | GUGCCCCUGAUGCGAUGCGGGGG |
| 1772 | 233 | UGCCCCUGAUGCGAUGCGGGGGC |
| 1773 | 234 | GCCCCUGAUGCGAUGCGGGGCU |
| 1774 | 235 | CCCCUGAUGCGAUGCGGGGCUG |
| 1775 | 236 | CCCUGAUGCGAUGCGGGGCUGC |
| 1776 | 237 | CCUGAUGCGAUGCGGGGCUGCU |
| 1777 | 238 | CUGAUGCGAUGCGGGGCUGCUG |

TABLE 4a-continued

Target sequences in VEGF-121

| SEQ ID NO: | position in VEGF-121 ORF | TARGET SEQUENCE IN VEGF121 mRNA 5' to 3' |
|---|---|---|
| 1778 | 239 | UGAUGCGAUGCGGGGCUGCUGC |
| 1779 | 240 | GAUGCGAUGCGGGGCUGCUGCA |
| 1780 | 241 | AUGCGAUGCGGGGCUGCUGCAA |
| 1781 | 242 | UGCGAUGCGGGGCUGCUGCAAU |
| 1782 | 243 | GCGAUGCGGGGCUGCUGCAAUG |
| 1783 | 244 | CGAUGCGGGGCUGCUGCAAUGA |
| 1784 | 245 | GAUGCGGGGCUGCUGCAAUGAC |
| 1785 | 246 | AUGCGGGGCUGCUGCAAUGACG |
| 1786 | 247 | UGCGGGGCUGCUGCAAUGACGA |
| 1787 | 248 | GCGGGGCUGCUGCAAUGACGAG |
| 1788 | 249 | CGGGGCUGCUGCAAUGACGAGG |
| 1789 | 250 | GGGGCUGCUGCAAUGACGAGGG |
| 1790 | 251 | GGGCUGCUGCAAUGACGAGGGC |
| 1791 | 252 | GGCUGCUGCAAUGACGAGGGCC |
| 1792 | 253 | GCUGCUGCAAUGACGAGGGCCU |
| 1793 | 254 | CUGCUGCAAUGACGAGGGCCUG |
| 1794 | 255 | UGCUGCAAUGACGAGGGCCUGG |
| 1795 | 256 | GCUGCAAUGACGAGGGCCUGGA |
| 1796 | 257 | CUGCAAUGACGAGGGCCUGGAG |
| 1797 | 258 | UGCAAUGACGAGGGCCUGGAGU |
| 1798 | 259 | GCAAUGACGAGGGCCUGGAGUG |
| 1799 | 260 | CAAUGACGAGGGCCUGGAGUGU |
| 1800 | 261 | AAUGACGAGGGCCUGGAGUGUG |
| 1801 | 262 | AUGACGAGGGCCUGGAGUGUGU |
| 1802 | 263 | UGACGAGGGCCUGGAGUGUGUG |
| 1803 | 264 | GACGAGGGCCUGGAGUGUGUGC |
| 1804 | 265 | ACGAGGGCCUGGAGUGUGUGCC |
| 1805 | 266 | CGAGGGCCUGGAGUGUGUGCCC |
| 1806 | 267 | GAGGGCCUGGAGUGUGUGCCCA |
| 1807 | 268 | AGGGCCUGGAGUGUGUGCCCAC |
| 1808 | 269 | GGGCCUGGAGUGUGUGCCCACU |
| 1809 | 270 | GGCCUGGAGUGUGUGCCCACUG |
| 1810 | 271 | GCCUGGAGUGUGUGCCCACUGA |
| 1811 | 272 | CCUGGAGUGUGUGCCCACUGAG |
| 1812 | 273 | CUGGAGUGUGUGCCCACUGAGG |
| 1813 | 274 | UGGAGUGUGUGCCCACUGAGGA |
| 1814 | 275 | GGAGUGUGUGCCCACUGAGGAG |
| 1815 | 276 | GAGUGUGUGCCCACUGAGGAGU |
| 1816 | 277 | AGUGUGUGCCCACUGAGGAGUC |
| 1817 | 278 | GUGUGUGCCCACUGAGGAGUCC |
| 1818 | 279 | UGUGUGCCCACUGAGGAGUCCA |
| 1819 | 280 | GUGUGCCCACUGAGGAGUCCAA |
| 1820 | 281 | UGUGCCCACUGAGGAGUCCAAC |
| 1821 | 282 | GUGCCCACUGAGGAGUCCAACA |
| 1822 | 283 | UGCCCACUGAGGAGUCCAACAU |
| 1823 | 284 | GCCCACUGAGGAGUCCAACAUC |
| 1824 | 285 | CCCACUGAGGAGUCCAACAUCA |
| 1825 | 286 | CCACUGAGGAGUCCAACAUCAC |
| 1826 | 287 | CACUGAGGAGUCCAACAUCACC |
| 1827 | 288 | ACUGAGGAGUCCAACAUCACCA |
| 1828 | 289 | CUGAGGAGUCCAACAUCACCAU |
| 1829 | 290 | UGAGGAGUCCAACAUCACCAUG |
| 1830 | 291 | GAGGAGUCCAACAUCACCAUGC |
| 1831 | 292 | AGGAGUCCAACAUCACCAUGCA |
| 1832 | 293 | GGAGUCCAACAUCACCAUGCAG |
| 1833 | 294 | GAGUCCAACAUCACCAUGCAGA |
| 1834 | 295 | AGUCCAACAUCACCAUGCAGAU |
| 1835 | 296 | GUCCAACAUCACCAUGCAGAUU |
| 1836 | 297 | UCCAACAUCACCAUGCAGAUUA |
| 1837 | 298 | CCAACAUCACCAUGCAGAUUAU |
| 1838 | 299 | CAACAUCACCAUGCAGAUUAUG |
| 1839 | 300 | AACAUCACCAUGCAGAUUAUGC |
| 1840 | 301 | ACAUCACCAUGCAGAUUAUGCG |
| 1841 | 302 | CAUCACCAUGCAGAUUAUGCGG |
| 1842 | 303 | AUCACCAUGCAGAUUAUGCGGA |
| 1843 | 304 | UCACCAUGCAGAUUAUGCGGAU |
| 1844 | 305 | CACCAUGCAGAUUAUGCGGAUC |
| 1845 | 306 | ACCAUGCAGAUUAUGCGGAUCA |
| 1846 | 307 | CCAUGCAGAUUAUGCGGAUCAA |
| 1847 | 308 | CAUGCAGAUUAUGCGGAUCAAA |
| 1848 | 309 | AUGCAGAUUAUGCGGAUCAAAC |
| 1849 | 310 | UGCAGAUUAUGCGGAUCAAACC |
| 1850 | 311 | GCAGAUUAUGCGGAUCAAACCU |
| 1851 | 312 | CAGAUUAUGCGGAUCAAACCUC |

TABLE 4a-continued

Target sequences in VEGF-121

| SEQ ID NO: | position in VEGF-121 ORF | TARGET SEQUENCE IN VEGF121 mRNA 5' to 3' |
|---|---|---|
| 1852 | 313 | CAGAUUAUGCGGAUCAAACCUCA |
| 1853 | 314 | AGAUUAUGCGGAUCAAACCUCAC |
| 1854 | 315 | GAUUAUGCGGAUCAAACCUCACC |
| 1855 | 316 | AUUAUGCGGAUCAAACCUCACCA |
| 1856 | 317 | UUAUGCGGAUCAAACCUCACCAA |
| 1857 | 318 | UAUGCGGAUCAAACCUCACCAAG |
| 1858 | 319 | AUGCGGAUCAAACCUCACCAAGG |
| 1859 | 320 | UGCGGAUCAAACCUCACCAAGGC |
| 1860 | 321 | GCGGAUCAAACCUCACCAAGGCC |
| 1861 | 322 | CGGAUCAAACCUCACCAAGGCCA |
| 1862 | 323 | GGAUCAAACCUCACCAAGGCCAG |
| 1863 | 324 | GAUCAAACCUCACCAAGGCCAGC |
| 1864 | 325 | AUCAAACCUCACCAAGGCCAGCA |
| 1865 | 326 | UCAAACCUCACCAAGGCCAGCAC |
| 1866 | 327 | CAAACCUCACCAAGGCCAGCACA |
| 1867 | 328 | AAACCUCACCAAGGCCAGCACAU |
| 1868 | 329 | AACCUCACCAAGGCCAGCACAUA |
| 1869 | 330 | ACCUCACCAAGGCCAGCACAUAG |
| 1870 | 331 | CCUCACCAAGGCCAGCACAUAGG |
| 1871 | 332 | CUCACCAAGGCCAGCACAUAGGA |
| 1872 | 333 | UCACCAAGGCCAGCACAUAGGAG |
| 1873 | 334 | CACCAAGGCCAGCACAUAGGAGA |
| 1874 | 335 | ACCAAGGCCAGCACAUAGGAGAG |
| 1875 | 336 | CCAAGGCCAGCACAUAGGAGAGA |
| 1876 | 337 | CAAGGCCAGCACAUAGGAGAGAU |
| 1877 | 338 | AAGGCCAGCACAUAGGAGAGAUG |
| 1878 | 339 | AGGCCAGCACAUAGGAGAGAUGA |
| 1879 | 340 | GGCCAGCACAUAGGAGAGAUGAG |
| 1880 | 341 | GCCAGCACAUAGGAGAGAUGAGC |
| 1881 | 342 | CCAGCACAUAGGAGAGAUGAGCU |
| 1882 | 343 | CAGCACAUAGGAGAGAUGAGCUU |
| 1883 | 344 | AGCACAUAGGAGAGAUGAGCUUC |
| 1884 | 345 | GCACAUAGGAGAGAUGAGCUUCC |
| 1885 | 346 | CACAUAGGAGAGAUGAGCUUCCU |
| 1886 | 347 | ACAUAGGAGAGAUGAGCUUCCUA |
| 1887 | 348 | CAUAGGAGAGAUGAGCUUCCUAC |
| 1888 | 349 | AUAGGAGAGAUGAGCUUCCUACA |
| 1889 | 350 | UAGGAGAGAUGAGCUUCCUACAG |
| 1890 | 351 | AGGAGAGAUGAGCUUCCUACAGC |
| 1891 | 352 | GGAGAGAUGAGCUUCCUACAGCA |
| 1892 | 353 | GAGAGAUGAGCUUCCUACAGCAC |
| 1893 | 354 | AGAGAUGAGCUUCCUACAGCACA |
| 1894 | 355 | GAGAUGAGCUUCCUACAGCACAA |
| 1895 | 356 | AGAUGAGCUUCCUACAGCACAAC |
| 1896 | 357 | GAUGAGCUUCCUACAGCACAACA |
| 1897 | 358 | AUGAGCUUCCUACAGCACAACAA |
| 1898 | 359 | UGAGCUUCCUACAGCACAACAAA |
| 1899 | 360 | GAGCUUCCUACAGCACAACAAAU |
| 1900 | 361 | AGCUUCCUACAGCACAACAAAUG |
| 1901 | 362 | GCUUCCUACAGCACAACAAAUGU |
| 1902 | 363 | CUUCCUACAGCACAACAAAUGUG |
| 1903 | 364 | UUCCUACAGCACAACAAAUGUGA |
| 1904 | 365 | UCCUACAGCACAACAAAUGUGAA |
| 1905 | 366 | CCUACAGCACAACAAAUGUGAAU |
| 1906 | 367 | CUACAGCACAACAAAUGUGAAUG |
| 1907 | 368 | UACAGCACAACAAAUGUGAAUGC |
| 1908 | 369 | ACAGCACAACAAAUGUGAAUGCA |
| 1909 | 370 | CAGCACAACAAAUGUGAAUGCAG |
| 1910 | 371 | AGCACAACAAAUGUGAAUGCAGA |
| 1911 | 372 | GCACAACAAAUGUGAAUGCAGAC |
| 1912 | 373 | CACAACAAAUGUGAAUGCAGACC |
| 1913 | 374 | ACAACAAAUGUGAAUGCAGACCA |
| 1914 | 375 | CAACAAAUGUGAAUGCAGACCAA |
| 1915 | 376 | AACAAAUGUGAAUGCAGACCAAA |
| 1916 | 377 | ACAAAUGUGAAUGCAGACCAAAG |
| 1917 | 378 | CAAAUGUGAAUGCAGACCAAAGA |
| 1918 | 379 | AAAUGUGAAUGCAGACCAAAGAA |
| 1919 | 380 | AAUGUGAAUGCAGACCAAAGAAA |
| 1920 | 381 | AUGUGAAUGCAGACCAAAGAAAG |
| 1921 | 382 | UGUGAAUGCAGACCAAAGAAAGA |
| 1922 | 383 | GUGAAUGCAGACCAAAGAAAGAU |
| 1923 | 384 | UGAAUGCAGACCAAAGAAAGAUA |
| 1924 | 385 | GAAUGCAGACCAAAGAAAGAUAG |
| 1925 | 386 | AAUGCAGACCAAAGAAAGAUAGA |

TABLE 4a-continued

Target sequences in VEGF-121

| SEQ ID NO: | position in VEGF-121 ORF | TARGET SEQUENCE IN VEGF121 mRNA 5' to 3' |
|---|---|---|
| 1926 | 387 | AUGCAGACCAAAGAAAGAUAGAG |
| 1927 | 388 | UGCAGACCAAAGAAAGAUAGAGC |
| 1928 | 389 | GCAGACCAAAGAAAGAUAGAGCA |
| 1929 | 390 | CAGACCAAAGAAAGAUAGAGCAA |
| 1930 | 391 | AGACCAAAGAAAGAUAGAGCAAG |
| 1931 | 392 | GACCAAAGAAAGAUAGAGCAAGA |
| 1932 | 393 | ACCAAAGAAAGAUAGAGCAAGAC |
| 1933 | 394 | CCAAAGAAAGAUAGAGCAAGACA |
| 1934 | 395 | CAAAGAAAGAUAGAGCAAGACAA |
| 1935 | 396 | AAAGAAAGAUAGAGCAAGACAAG |
| 1936 | 397 | AAGAAAGAUAGAGCAAGACAAGA |
| 1937 | 398 | AGAAAGAUAGAGCAAGACAAGAA |
| 1938 | 399 | GAAAGAUAGAGCAAGACAAGAAA |
| 1939 | 400 | AAAGAUAGAGCAAGACAAGAAAA |

TABLE 4b

VEGF targeted duplexes

| position in ORF | SEQ ID NO: | Target sequence (5'-3') | Duplex ID | Strand | SEQ ID NO: | Strand Sequences |
|---|---|---|---|---|---|---|
| 1 | 2184 | AUGAACUUUCUGCUGUCUUGGGU | AL-DP-4043 | S | 1940 | 5 GAACUUUCUGCUGUCUUGGGU 3 |
| | | | | AS | 1941 | 3 UACUUGAAAGACGACAGAACCCA 5 |
| 22 | 2185 | GUGCAUUGGAGCCUUGCCUUGCU | AL-DP-4077 | S | 1942 | 5 GCAUUGGAGCCUUGCCUUGCU 3 |
| | | | | AS | 1943 | 3 CACGUAACCUCGGAACGGAACGA 5 |
| 47 | 2186 | UCUACCUCCACCAUGCCAAGUGG | AL-DP-4021 | S | 1944 | 5 UACCUCCACCAUGCCAAGUTT 3 |
| | | | | AS | 1945 | 3 TTAUGGAGGUGGUACGGUUCA 5 |
| 48 | 2187 | CUACCUCCACCAUGCCAAGUGGU | AL-DP-4109 | S | 1946 | 5 ACCUCCACCAUGCCAAGUGT T 3 |
| | | | | AS | 1947 | 3 TTUGGAGGUGGUACGGUUCAC 5 |
| 50 | 2188 | ACCUCCACCAUGCCAAGUGGUCC | AL-DP-4006 | S | 1948 | 5 CUCCACCAUGCCAAGUGGUCC 3 |
| | | | | AS | 1949 | 3 UGGAGGUGGUACGGUUCACCAGG 5 |
| | | | AL-DP-4083 | S | 1950 | 5 CUCCACCAUGCCAAGUGGUTT 3 |
| | | | | AS | 1951 | 3 TTGAGGUGGUACGGUUCACCA 5 |
| 51 | 2189 | CCUCCACCAUGCCAAGUGGUCCC | AL-DP-4047 | S | 1952 | 5 UCCACCAUGCCAAGUGGUCCC 3 |
| | | | | AS | 1953 | 3 GGAGGUGGUACGGUUCACCAGGG 5 |
| | | | AL-DP-4017 | S | 1954 | 5 UCCACCAUGCCAAGUGGUCTT 3 |
| | | | | AS | 1955 | 3 TTAGGUGGUACGGUUCACCAG 5 |
| 52 | 2190 | CUCCACCAUGCCAAGUGGUCCCA | AL-DP-4048 | S | 1956 | 5 CCACCAUGCCAAGUGGUCCCA 3 |
| | | | | AS | 1957 | 3 GAGGUGGUACGGUUCACCAGGGU 5 |
| | | | AL-DP-4103 | S | 1958 | 5 CCACCAUGCCAAGUGGUCCTT 3 |
| | | | | AS | 1959 | 3 TTGGUGGUACGGUUCACCAGG 5 |
| 53 | 2191 | UCCACCAUGCCAAGUGGUCCCAG | AL-DP-4035 | S | 1960 | 5 CACCAUGCCAAGUGGUCCCAG 3 |
| | | | | AS | 1961 | 3 AGGUGGUACGGUUCACCAGGGUC 5 |
| | | | AL-DP-4018 | S | 1962 | 5 CACCAUGCCAAGUGGUCCCTT 3 |
| | | | | AS | 1963 | 3 TTGUGGUACGGUUCACCAGGG 5 |
| 54 | 2192 | CCACCAUGCCAAGUGGUCCCAGG | AL-DP-4036 | S | 1964 | 5 ACCAUGCCAAGUGGUCCCAGG 3 |
| | | | | AS | 1965 | 3 GGUGGUACGGUUCACCAGGGUCC 5 |
| | | | AL-DP-4084 | S | 1966 | 5 ACCAUGCCAAGUGGUCCCATT 3 |
| | | | | AS | 1967 | 3 TTUGGUACGGUUCACCAGGGU 5 |
| 55 | 2193 | CACCAUGCCAAGUGGUCCCAGGC | AL-DP-4093 | S | 1968 | 5 CCAUGCCAAGUGGUCCCAGGC 3 |
| | | | | AS | 1969 | 3 GUGGUACGGUUCACCAGGGUCCG 5 |
| | | | AL-DP-4085 | S | 1970 | 5 CCAUGCCAAGUGGUCCCAGTT 3 |
| | | | | AS | 1971 | 3 TTGGUACGGUUCACCAGGGUC 5 |
| 56 | 2194 | ACCAUGCCAAGUGGUCCCAGGCU | AL-DP-4037 | S | 1972 | 5 CAUGCCAAGUGGUCCCAGGCU 3 |
| | | | | AS | 1973 | 3 UGGUACGGUUCACCAGGGUCCGA 5 |
| | | | AL-DP-4054 | S | 1974 | 5 CAUGCCAAGUGGUCCCAGGTT 3 |
| | | | | AS | 1975 | 3 TTGUACGGUUCACCAGGGUCC 5 |

TABLE 4b-continued

VEGF targeted duplexes

| position in ORF | SEQ ID NO: | Target sequence (5'-3') | Duplex ID | Strand | SEQ ID NO: | Strand Sequences |
|---|---|---|---|---|---|---|
| 57 | 2195 | CCAUGCCAAGUGGUCCCAGGCUG | AL-DP-4038 | S | 1976 | 5 AUGCCAAGUGGUCCCAGGCUG 3 |
| | | | | AS | 1977 | 3 GGUACGGUUCACCAGGGUCCGAC 5 |
| | | | AL-DP-4086 | S | 1978 | 5 AUGCCAAGUGGUCCCAGGCUT 3 |
| | | | | AS | 1979 | 3 TTUACGGUUCACCAGGGUCCG 5 |
| 58 | 2196 | CAUGCCAAGUGGUCCCAGGCUGC | AL-DP-4049 | S | 1980 | 5 UGCCAAGUGGUCCCAGGCUGC 3 |
| | | | | AS | 1981 | 3 GUACGGUUCACCAGGGUCCGACG 5 |
| | | | AL-DP-4087 | S | 1982 | 5 UGCCAAGUGGUCCCAGGCUT 3 |
| | | | | AS | 1983 | 3 TTACGGUUCACCAGGGUCCGA 5 |
| 59 | 2197 | AUGCCAAGUGGUCCCAGGCUGCA | AL-DP-4001 | S | 1984 | 5 GCCAAGUGGUCCCAGGCUGCA 3 |
| | | | | AS | 1985 | 3 UACGGUUCACCAGGGUCCGACGU 5 |
| | | | AL-DP-4052 | A | 1986 | 5 GCCAAGUGGUCCCAGGCUT 3 |
| | | | | AS | 1987 | 3 TTCGGUUCACCAGGGUCCGAC 5 |
| 60 | 2198 | UGCCAAGUGGUCCCAGGCUGCAC | AL-DP-4007 | S | 1988 | 5 CCAAGUGGUCCCAGGCUGCAC 3 |
| | | | | AS | 1989 | 3 ACGGUUCACCAGGGUCCGACGUG 5 |
| | | | AL-DP-4088 | S | 1990 | 5 CCAAGUGGUCCCAGGCUGCTT 3 |
| | | | | AS | 1991 | 3 TTGGUUCACCAGGGUCCGACG 5 |
| 61 | 2199 | GCCAAGUGGUCCCAGGCUGCACC | AL-DP-4070 | S | 1992 | 5 CAAGUGGUCCCAGGCUGCACC 3 |
| | | | | AS | 1993 | 3 CGGUUCACCAGGGUCCGACGUGG 5 |
| | | | AL-DP-4055 | S | 1994 | 5 CAAGUGGUCCCAGGCUGCATT 3 |
| | | | | AS | 1995 | 3 TTGUUCACCAGGGUCCGACGU 5 |
| 62 | 2200 | CCAAGUGGUCCCAGGCUGCACCC | AL-DP-4071 | S | 1996 | 5 AAGUGGUCCCAGGCUGCACCC 3 |
| | | | | AS | 1997 | 3 GGUUCACCAGGGUCCGACGUGGG 5 |
| | | | AL-DP-4056 | S | 1998 | 5 AAGUGGUCCCAGGCUGCACTT 3 |
| | | | | AS | 1999 | 3 TTUUCACCAGGGUCCGACGUG 5 |
| 63 | 2201 | CAAGUGGUCCCAGGCUGCACCCA | AL-DP-4072 | S | 2000 | 5 AGUGGUCCCAGGCUGCACCCA 3 |
| | | | | AS | 2001 | 3 GUUCACCAGGGUCCGACGUGGGU 5 |
| | | | AL-DP-4057 | S | 2002 | 5 AGUGGUCCCAGGCUGCACCTT 3 |
| | | | | AS | 2003 | 3 TTUCACCAGGGUCCGACGUGG 5 |
| 64 | 2202 | AAGUGGUCCCAGGCUGCACCCAU | AL-DP-4066 | S | 2004 | 5 GUGGUCCCAGGCUGCACCCTT 3 |
| | | | | AS | 2005 | 3 TTCACCAGGGUCCGACGUGGG 5 |
| 99 | 2203 | AGGGCAGAAUCAUCACGAAGUGG | AL-DP-4022 | S | 2006 | 5 GGCAGAAUCAUCACGAAGUTT 3 |
| | | | | AS | 2007 | 3 TTCCGUCUUAGUAGUGCUUCA 5 |
| 100 | 2204 | GGGCAGAAUCAUCACGAAGUGGU | AL-DP-4023 | S | 2008 | 5 GCAGAAUCAUCACGAAGUGTT 3 |
| | | | | AS | 2009 | 3 TTCGUCUUAGUAGUGCUUCAC 5 |
| 101 | 2205 | GGCAGAAUCAUCACGAAGUGGUG | AL-DP-4024 | S | 2010 | 5 CAGAAUCAUCACGAAGUGGTT 3 |
| | | | | AS | 2011 | 3 TTGUCUUAGUAGUGCUUCACC 5 |
| 102 | 2206 | GCAGAAUCAUCACGAAGUGGUGA | AL-DP-4076 | S | 2012 | 5 AGAAUCAUCACGAAGUGGUGA 3 |
| | | | | AS | 2013 | 3 CGUCUUAGUAGUGCUUCACCACU 5 |
| | | | AL-DP-4019 | S | 2014 | 5 AGAAUCAUCACGAAGUGGUTT 3 |
| | | | | AS | 2015 | 3 TTUCUUAGUAGUGCUUCACCA 5 |
| 103 | 2207 | CAGAAUCAUCACGAAGUGGUGAA | AL-DP-4025 | S | 2016 | 5 GAAUCAUCACGAAGUGGUGTT 3 |
| | | | | AS | 2017 | 3 TTCUUAGUAGUGCUUCACCAC 5 |
| 104 | 2208 | AGAAUCAUCACGAAGUGGUGAAG | AL-DP-4110 | S | 2018 | 5 AAUCAUCACGAAGUGGUGATT 3 |
| | | | | AS | 2019 | 3 TTUUAGUAGUGCUUCACCACU 5 |
| 105 | 2209 | GAAUCAUCACGAAGUGGUGAAGU | AL-DP-4068 | S | 2020 | 5 AUCAUCACGAAGUGGUGAATT 3 |
| | | | | AS | 2021 | 3 TTUAGUAGUGCUUCACCACUU 5 |
| 113 | 2210 | ACGAAGUGGUGAAGUUCAUGGAU | AL-DP-4078 | S | 2022 | 5 GAAGUGGUGAAGUUCAUGGAU 3 |
| | | | | AS | 2023 | 3 UGCUUCACCACUUCAAGUACCUA 5 |
| 121 | 2211 | GUGAAGUUCAUGGAUGUCUAUCA | AL-DP-4080 | S | 2024 | 5 GAAGUUCAUGGAUGUCUAUCA 3 |
| | | | | AS | 2025 | 3 CACUUCAAGUACCUACAGAUAGU 5 |
| 129 | 2212 | CAUGGAUGUCUAUCAGCGCAGCU | AL-DP-4111 | S | 2026 | 5 UGGAUGUCUAUCAGCGCAGTT 3 |
| | | | | AS | 2027 | 3 TTACCUACAGAUAGUCGCGUC 5 |
| 130 | 2213 | AUGGAUGUCUAUCAGCGCAGCUA | AL-DP-4041 | S | 2028 | 5 GGAUGUCUAUCAGCGCAGCUA 3 |
| | | | | AS | 2029 | 3 UACCUACAGAUAGUCGCGUCGAU 5 |
| | | | AL-DP-4062 | S | 2030 | 5 GGAUGUCUAUCAGCGCAGCTT 3 |
| | | | | AS | 2031 | 3 TTCCUACAGAUAGUCGCGUCG 5 |

TABLE 4b-continued

VEGF targeted duplexes

| position in ORF | SEQ ID NO: | Target sequence (5'-3') | Duplex ID | Strand | SEQ ID NO: | Strand Sequences |
|---|---|---|---|---|---|---|
| 131 | 2214 | UGGAUGUCUAUCAGCGCAGCUAC | AL-DP-4069 | S | 2032 | 5 GAUGUCUAUCAGCGCAGCUTT 3 |
| | | | | AS | 2033 | 3 TTCUACAGAUAGUCGCGUCGA 5 |
| 132 | 2215 | GGAUGUCUAUCAGCGCAGCUACU | AL-DP-4112 | S | 2034 | 5 AUGUCUAUCAGCGCAGCUATT 3 |
| | | | | AS | 2035 | 3 TTUACAGAUAGUCGCGUCGAU 5 |
| 133 | 2216 | GAUGUCUAUCAGCGCAGCUACUG | AL-DP-4026 | S | 2036 | 5 UGUCUAUCAGCGCAGCUACTT 3 |
| | | | | AS | 2037 | 3 TTACAGAUAGUCGCGUCGAUG 5 |
| 134 | 2217 | AUGUCUAUCAGCGCAGCUACUGC | AL-DP-4095 | S | 2038 | 5 GUCUAUCAGCGCAGCUACUGC 3 |
| | | | | AS | 2039 | 3 UACAGAUAGUCGCGUCGAUGACG 5 |
| | | | AL-DP-4020 | S | 2040 | 5 GUCUAUCAGCGCAGCUACUTT 3 |
| | | | | AS | 2041 | 3 TTCAGAUAGUCGCGUCGAUGA 5 |
| 135 | 2218 | UGUCUAUCAGCGCAGCUACUGCC | AL-DP-4027 | S | 2042 | 5 UCUAUCAGCGCAGCUACUGTT 3 |
| | | | | AS | 2043 | 3 TTAGAUAGUCGCGUCGAUGAC 5 |
| 144 | 2219 | GCGCAGCUACUGCCAUCCAAUCG | AL-DP-4081 | S | 2044 | 5 GCAGCUACUGCCAUCCAAUCG 3 |
| | | | | AS | 2045 | 3 CGCGUCGAUGACGGUAGGUUAGC 5 |
| 146 | 2220 | GCAGCUACUGCCAUCCAAUCGAG | AL-DP-4098 | S | 2046 | 5 AGCUACUGCCAUCCAAUCGAG 3 |
| | | | | AS | 2047 | 3 CGUCGAUGACGGUAGGUUAGCUC 5 |
| 149 | 2221 | GCUACUGCCAUCCAAUCGAGACC | AL-DP-4028 | S | 2048 | 5 UACUGCCAUCCAAUCGAGATT 3 |
| | | | | AS | 2049 | 3 TTAUGACGGUAGGUUAGCUCU 5 |
| 150 | 2222 | CUACUGCCAUCCAAUCGAGACCC | AL-DP-4029 | S | 2050 | 5 ACUGCCAUCCAAUCGAGACTT 3 |
| | | | | AS | 2051 | 3 TTUGACGGUAGGUUAGCUCUG 5 |
| 151 | 2223 | UACUGCCAUCCAAUCGAGACCCU | AL-DP-4030 | S | 2052 | 5 CUGCCAUCCAAUCGAGACCTT 3 |
| | | | | AS | 2053 | 3 TTGACGGUAGGUUAGCUCUGG 5 |
| 152 | 2224 | ACUGCCAUCCAAUCGAGACCCUG | AL-DP-4031 | S | 2054 | 5 UGCCAUCCAAUCGAGACCCTT 3 |
| | | | | AS | 2055 | 3 TTACGGUAGGUUAGCUCUGGG 5 |
| 166 | 2225 | GAGACCCUGGUGGACAUCUUCCA | AL-DP-4008 | S | 2056 | 5 GACCCUGGUGGACAUCUUCCA 3 |
| | | | | AS | 2057 | 3 CUCUGGGACCACCUGUAGAAGGU 5 |
| | | | AL-DP-4058 | S | 2058 | 5 GACCCUGGUGGACAUCUUCTT 3 |
| | | | | AS | 2059 | 3 TTCUGGGACCACCUGUAGAAG 5 |
| 167 | 2226 | AGACCCUGGUGGACAUCUUCCAG | AL-DP-4009 | S | 2060 | 5 ACCCUGGUGGACAUCUUCCAG 3 |
| | | | | AS | 2061 | 3 UCUGGGACCACCUGUAGAAGGUC 5 |
| | | | AL-DP-4059 | S | 2062 | 5 ACCCUGGUGGACAUCUUCCTT 3 |
| | | | | AS | 2063 | 3 TTUGGGACCACCUGUAGAAGG 5 |
| 168 | 2227 | GACCCUGGUGGACAUCUUCCAGG | AL-DP-4010 | S | 2064 | 5 CCCUGGUGGACAUCUUCCAGG 3 |
| | | | | AS | 2065 | 3 CUGGGACCACCUGUAGAAGGUCC 5 |
| | | | AL-DP-4060 | S | 2066 | 5 CCCUGGUGGACAUCUUCCATT 3 |
| | | | | AS | 2067 | 3 TTGGGACCACCUGUAGAAGGU 5 |
| 169 | 2228 | ACCCUGGUGGACAUCUUCCAGGA | AL-DP-4073 | S | 2068 | 5 CCUGGUGGACAUCUUCCAGGA 3 |
| | | | | AS | 2069 | 3 UGGGACCACCUGUAGAAGGUCCU 5 |
| | | | AL-DP-4104 | S | 2070 | 5 CCUGGUGGACAUCUUCCAGTT 3 |
| | | | | AS | 2071 | 3 TTGGACCACCUGUAGAAGGUC 5 |
| 170 | 2229 | CCCUGGUGGACAUCUUCCAGGAG | AL-DP-4011 | S | 2072 | 5 CUGGUGGACAUCUUCCAGGAG 3 |
| | | | | AS | 2073 | 3 GGGACCACCUGUAGAAGGUCCUC 5 |
| | | | AL-DP-4089 | S | 2074 | 5 CUGGUGGACAUCUUCCAGGTT 3 |
| | | | | AS | 2075 | 3 TTGACCACCUGUAGAAGGUCC 5 |
| 171 | 2230 | CCUGGUGGACAUCUUCCAGGAGU | AL-DP-4074 | S | 2076 | 5 UGGUGGACAUCUUCCAGGAGU 3 |
| | | | | AS | 2077 | 3 GGACCACCUGUAGAAGGUCCUCA 5 |
| | | | AL-DP-4090 | S | 2078 | 5 UGGUGGACAUCUUCCAGGATT 3 |
| | | | | AS | 2079 | 3 TTACCACCUGUAGAAGGUCCU 5 |
| 172 | 2231 | CUGGUGGACAUCUUCCAGGAGUA | AL-DP-4039 | S | 2080 | 5 GGUGGACAUCUUCCAGGAGUA 3 |
| | | | | AS | 2081 | 3 GACCACCUGUAGAAGGUCCUCAU 5 |
| | | | AL-DP-4091 | S | 2082 | 5 GGUGGACAUCUUCCAGGAGTT 3 |
| | | | | AS | 2083 | 3 TTCCACCUGUAGAAGGUCCUC 5 |

TABLE 4b-continued

VEGF targeted duplexes

| position in ORF | SEQ ID NO: | Target sequence (5'-3') | Duplex ID | Strand | SEQ ID NO: | Strand Sequences |
|---|---|---|---|---|---|---|
| 175 | 2232 | GUGGACAUCUUCCAGGAGUACCC | AL-DP-4003 | S | 2084 | 5 GGACAUCUUCCAGGAGUACCC 3 |
| | | | | AS | 2085 | 3 CCUGUAGAAGGUCCUCAUGGG 5 |
| | | | AL-DP-4116 | S | 2086 | 5 GGACAUCUUCCAGGAGUACCC 3 |
| | | | | AS | 2087 | 3 CCUGUAGAAGGUCCUCAUGGG 5 |
| | | | AL-DP-4015 | S | 2088 | 5 GGACAUCUUCCAGGAGUACTT 3 |
| | | | | AS | 2089 | 3 TTCCUGUAGAAGGUCCUCAUG 5 |
| | | | AL-DP-4120 | S | 2090 | 5 GGACAUCUUCCAGGAGUAC 3 |
| | | | | AS | 2091 | 3 CCUGUAGAAGGUCCUCAUG 5 |
| 179 | 2233 | ACAUCUUCCAGGAGUACCCUGAU | AL-DP-4099 | S | 2092 | 5 AUCUUCCAGGAGUACCCUGAU 3 |
| | | | | AS | 2093 | 3 UGUAGAAGGUCCUCAUGGGACUA 5 |
| 191 | 2234 | AGUACCCUGAUGAGAUCGAGUAC | AL-DP-4032 | S | 2094 | 5 UACCCUGAUGAGAUCGAGUTT 3 |
| | | | | AS | 2095 | 3 TTAUGGGACUACUCUAGCUCA 5 |
| 192 | 2235 | GUACCCUGAUGAGAUCGAGUACA | AL-DP-4042 | S | 2096 | 5 ACCCUGAUGAGAUCGAGUACA 3 |
| | | | | AS | 2097 | 3 CAUGGGACUACUCUAGCUCAUGU 5 |
| | | | AL-DP-4063 | S | 2098 | 5 ACCCUGAUGAGAUCGAGUAT T 3 |
| | | | | AS | 2099 | 3 TTGGGACUACUCUAGCUCAU 5 |
| 209 | 2236 | AGUACAUCUUCAAGCCAUCCUGU | AL-DP-4064 | S | 2100 | 5 UACAUCUUCAAGCCAUCCUTT 3 |
| | | | | AS | 2101 | 3 TTAUGUAGAAGUUCGGUAGGA 5 |
| 260 | 2237 | GCAAUGACGAGGGCCUGGAGUGU | AL-DP-4044 | S | 2102 | 5 AAUGACGAGGGCCUGGAGUGU 3 |
| | | | | AS | 2103 | 3 CGUUACUGCUCCCGGACCUCACA 5 |
| 263 | 2238 | AUGACGAGGGCCUGGAGUGUGUG | AL-DP-4045 | S | 2104 | 5 GACGAGGGCCUGGAGUGUGUG 3 |
| | | | | AS | 2105 | 3 UACUGCUCCCGGACCUCACACAC 5 |
| 279 | 2239 | GUGUGUGCCCACUGAGGAGUCCA | AL-DP-4046 | S | 2106 | 5 GUGUGCCCACUGAGGAGUCCA 3 |
| | | | | AS | 2107 | 3 CACACACGGGUGACUCCUCAGGU 5 |
| 281 | 2240 | GUGUGCCCACUGAGGAGUCCAAC | AL-DP-4096 | S | 2108 | 5 GUGCCCACUGAGGAGUCCAAC 3 |
| | | | | AS | 2109 | 3 CACACGGGUGACUCCUCAGGUUG 5 |
| 283 | 2241 | GUGCCCACUGAGGAGUCCAACAU | AL-DP-4040 | S | 2110 | 5 GCCCACUGAGGAGUCCAACAU 3 |
| | | | | AS | 2111 | 3 CACGGGUGACUCCUCAGGUUGUA 5 |
| 289 | 2242 | ACUGAGGAGUCCAACAUCACCAU | AL-DP-4065 | S | 2112 | 5 UGAGGAGUCCAACAUCACCTT 3 |
| | | | | AS | 2113 | 3 TTACUCCUCAGGUUGUAGUGG 5 |
| 302 | 2243 | ACAUCACCAUGCAGAUUAUGCGG | AL-DP-4100 | S | 2114 | 5 AUCACCAUGCAGAUUAUGCGG 3 |
| | | | | AS | 2115 | 3 UGUAGUGGUACGUCUAAUACGCC 5 |
| 305 | 2244 | UCACCAUGCAGAUUAUGCGGAUC | AL-DP-4033 | S | 2116 | 5 ACCAUGCAGAUUAUGCGGATT 3 |
| | | | | AS | 2117 | 3 TTUGGUACGUCUAAUACGCCU 5 |
| 310 | 2245 | AUGCAGAUUAUGCGGAUCAAACC | AL-DP-4101 | S | 2118 | 5 GCAGAUUAUGCGGAUCAAACC 3 |
| | | | | AS | 2119 | 3 UACGUCUAAUACGCCUAGUUUGG 5 |
| 312 | 2246 | GCAGAUUAUGCGGAUCAAACCUC | AL-DP-4102 | S | 2120 | 5 AGAUUAUGCGGAUCAAACCUC 3 |
| | | | | AS | 2121 | 3 CGUCUAAUACGCCUAGUUUGGAG 5 |
| 315 | 2247 | GAUUAUGCGGAUCAAACCUCACC | AL-DP-4034 | S | 2122 | 5 UUAUGCGGAUCAAACCUCATT 3 |
| | | | | AS | 2123 | 3 TTAAUACGCCUAGUUUGGAGU 5 |
| 316 | 2248 | AUUAUGCGGAUCAAACCUCACCA | AL-DP-4113 | S | 2124 | 5 UAUGCGGAUCAAACCUCACTT 3 |
| | | | | AS | 2125 | 3 TTAUACGCCUAGUUUGGAGUG 5 |
| 317 | 2249 | UUAUGCGGAUCAAACCUCACCAA | AL-DP-4114 | S | 2126 | 5 AUGCGGAUCAAACCUCACCTT 3 |
| | | | | AS | 2127 | 3 TTUACGCCUAGUUUGGAGUGG 5 |
| 319 | 2250 | AUGCGGAUCAAACCUCACCAAGG | AL-DP-4002 | S | 2128 | 5 GCGGAUCAAACCUCACCAAGG 3 |
| | | | | AS | 2129 | 3 UACGCCUAGUUUGGAGUGGUUCC 5 |
| | | | AL-DP-4115 | S | 2130 | 5 GCGGAUCAAACCUCACCAA 3 |
| | | | | AS | 2131 | 3 CGCCUAGUUUGGAGUGGUU 5 |
| | | | AL-DP-4014 | S | 2132 | 5 GCGGAUCAAACCUCACCAATT 3 |
| | | | | AS | 2133 | 3 TTCGCCUAGUUUGGAGUGGUU 5 |
| | | | AL-DP-4119 | S | 2134 | 5 GCGGAUCAAACCUCACCAA 3 |
| | | | | AS | 2135 | 3 CGCCUAGUUUGGAGUGGUU 5 |

TABLE 4b-continued

VEGF targeted duplexes

| position in ORF | SEQ ID NO: | Target sequence (5'-3') | Duplex ID | Strand | SEQ ID NO: | Strand Sequences |
|---|---|---|---|---|---|---|
| 321 | 2251 | GCGGAUCAAACCUCACCAAGGCC | AL-DP-4013 | S | 2136 | 5 GGAUCAAACCUCACCAAGGCC 3 |
| | | | | AS | 2137 | 3 CGCCUAGUUUGGAGUGGUUCCGG 5 |
| 341 | 2252 | GCCAGCACAUAGGAGAGAUGAGC | AL-DP-4075 | S | 2138 | 5 CAGCACAUAGGAGAGAUGAGC 3 |
| | | | | AS | 2139 | 3 CGGUCGUGUAUCCUCUCUACUCG 5 |
| | | | AL-DP-4105 | S | 2140 | 5 CAGCACAUAGGAGAGAUGAUT 3 |
| | | | | AS | 2141 | 3 TTGUCGUGUAUCCUCUCUACU 5 |
| 342 | 2253 | CCAGCACAUAGGAGAGAUGAGCU | AL-DP-4050 | S | 2142 | 5 AGCACAUAGGAGAGAUGAGCU 3 |
| | | | | AS | 2143 | 3 GGUCGUGUAUCCUCUCUACUCGA 5 |
| | | | AL-DP-4106 | S | 2144 | 5 AGCACAUAGGAGAGAUGAGT T 3 |
| | | | | AS | 2145 | 3 TTUCGUGUAUCCUCUCUACUC 5 |
| 343 | 2254 | CAGCACAUAGGAGAGAUGAGCUU | AL-DP-4094 | S | 2146 | 5 GCACAUAGGAGAGAUGAGCUU 3 |
| | | | | AS | 2147 | 3 GUCGUGUAUCCUCUCUACUCGAA 5 |
| | | | AL-DP-4118 | S | 2148 | 5 GCACAUAGGAGAGAUGAGCUU 3 |
| | | | | AS | 2149 | 3 CGUGUAUCCUCUCUACUCGAA 5 |
| | | | AL-DP-4107 | S | 2150 | 5 GCACAUAGGAGAGAUGAGCTT 3 |
| | | | | AS | 2151 | 3 TTCGUGUAUCCUCUCUACUCG 5 |
| | | | AL-DP-4122 | S | 2152 | 5 GCACAUAGGAGAGAUGAGC 3 |
| | | | | AS | 2153 | 3 CGUGUAUCCUCUCUACUCG 5 |
| 344 | 2255 | AGCACAUAGGAGAGAUGAGCUUC | AL-DP-4012 | S | 2154 | 5 CACAUAGGAGAGAUGAGCUUC 3 |
| | | | | AS | 2155 | 3 UCGUGUAUCCUCUCUACUCGAAG 5 |
| | | | AL-DP-4108 | S | 2156 | 5 CACAUAGGAGAGAUGAGCUTT 3 |
| | | | | AS | 2157 | 3 TTGUGUAUCCUCUCUACUCGA 5 |
| 346 | 2256 | CACAUAGGAGAGAUGAGCUUCCU | AL-DP-4051 | S | 2158 | 5 CAUAGGAGAGAUGAGCUUCCU 3 |
| | | | | AS | 2159 | 3 GUGUAUCCUCUCUACUCGAAGGA 5 |
| | | | AL-DP-4061 | S | 2160 | 5 CAUAGGAGAGAUGAGCUUCTT 3 |
| | | | | AS | 2161 | 3 TTGUAUCCUCUCUACUCGAAG 5 |
| 349 | 2257 | AUAGGAGAGAUGAGCUUCCUACA | AL-DP-4082 | S | 2162 | 5 AGGAGAGAUGAGCUUCCUACA 3 |
| | | | | AS | 2163 | 3 UAUCCUCUCUACUCGAAGGAUGU 5 |
| 369 | 2258 | ACAGCACAACAAAUGUGAAUGCA | AL-DP-4079 | S | 2164 | 5 AGCACAACAAAUGUGAAUGCA 3 |
| | | | | AS | 2165 | 3 UGUCGUGUUGUUUACACUUACGU 5 |
| 372 | 2259 | GCACAACAAAUGUGAAUGCAGAC | AL-DP-4097 | S | 2166 | 5 ACAACAAAUGUGAAUGCAGAC 3 |
| | | | | AS | 2167 | 3 CGUGUUGUUUACACUUACGUCUG 5 |
| 379 | 2260 | AAAUGUGAAUGCAGACCAAAGAA | AL-DP-4067 | S | 2168 | 5 AUGUGAAUGCAGACCAAAGTT 3 |
| | | | | AS | 2169 | 3 TTUACACUUACGUCUGGUUUC 5 |
| 380 | 2261 | AAUGUGAAUGCAGACCAAAGAAA | AL-DP-4092 | S | 2170 | 5 UGUGAAUGCAGACCAAAGAUU 3 |
| | | | | AS | 2171 | 3 TTACACUUACGUCUGGUUUCU 5 |
| 381 | 2262 | AUGUGAAUGCAGACCAAAGAAAG | AL-DP-4004 | S | 2172 | 5 GUGAAUGCAGACCAAAGAAAG 3 |
| | | | | AS | 2173 | 3 UACACUUACGUCUGGUUUCUUUC 5 |
| | | | AL-DP-4117 | S | 2174 | 5 GUGAAUGCAGACCAAAGAAAG 3 |
| | | | | AS | 2175 | 3 CACUUACGUCUGGUUUCUUUC 5 |
| | | | AL-DP-4016 | S | 2176 | 5 GUGAAUGCAGACCAAAGAATT 3 |
| | | | | AS | 2177 | 3 TTCACUUACGUCUGGUUUCUU 5 |
| | | | AL-DP-4121 | S | 2178 | 5 GUGAAUGCAGACCAAAGAA 3 |
| | | | | AS | 2179 | 3 CACUUACGUCUGGUUUCUU 5 |
| 383 | 2263 | GUGAAUGCAGACCAAAGAAAGAU | AL-DP-4005 | S | 2180 | 5 GAAUGCAGACCAAAGAAAGAU 3 |
| | | | | AS | 2181 | 3 CACUUACGUCUGGUUUCUUUCUA 5 |
| | | | AL-DP-4053 | S | 2182 | 5 GAAUGCAGACCAAAGAAAGTT 3 |
| | | | | AS | 2183 | 3 TTCUUACGUCUGGUUUCUUUC 5 |

Strand:
S = sense,
AS = Antisense

Example 2

Eg5 siRNA In Vitro Screening Via Cell Proliferation

As silencing of Eg5 has been shown to cause mitotic arrest (Weil, D, et al [2002] Biotechniques 33: 1244-8), a cell viability assay was used for siRNA activity screening. HeLa cells (14000 per well [Screens 1 and 3] or 10000 per well [Screen2])) were seeded in 96-well plates and simultaneously transfected with Lipofectamine 2000 (Invitrogen) at a final siRNA concentration in the well of 30 nM and at final concentrations of 50 nM ($1^{st}$ screen) and 25 nM ($2^{nd}$ screen). A subset of duplexes was tested at 25 nM in a third screen (Table 5).

Seventy-two hours post-transfection, cell proliferation was assayed the addition of WST-1 reagent (Roche) to the culture medium, and subsequent absorbance measurement at 450 nm. The absorbance value for control (non-transfected) cells was considered 100 percent, and absorbances for the siRNA transfected wells were compared to the control value. Assays were performed in sextuplicate for each of three screens. A subset of the siRNAs was further tested at a range of siRNA concentrations. Assays were performed in HeLa cells (14000 per well; method same as above, Table 5).

TABLE 5

Effects of Eg5 targeted duplexes on cell viability at 25 nM.

Relative absorbance at 450 nm

| Duplex | Screen I mean | sd | Screen II Mean | sd | Screen III mean | Sd |
|---|---|---|---|---|---|---|
| AL-DP-6226 | 20 | 10 | 28 | 11 | 43 | 9 |
| AL-DP-6227 | 66 | 27 | 96 | 41 | 108 | 33 |
| AL-DP-6228 | 56 | 28 | 76 | 22 | 78 | 18 |
| AL-DP-6229 | 17 | 3 | 31 | 9 | 48 | 13 |
| AL-DP-6230 | 48 | 8 | 75 | 11 | 73 | 7 |
| AL-DP-6231 | 8 | 1 | 21 | 4 | 41 | 10 |
| AL-DP-6232 | 16 | 2 | 37 | 7 | 52 | 14 |
| AL-DP-6233 | 31 | 9 | 37 | 6 | 49 | 12 |
| AL-DP-6234 | 103 | 40 | 141 | 29 | 164 | 45 |
| AL-DP-6235 | 107 | 34 | 140 | 27 | 195 | 75 |
| AL-DP-6236 | 48 | 12 | 54 | 12 | 56 | 12 |
| AL-DP-6237 | 73 | 14 | 108 | 18 | 154 | 37 |
| AL-DP-6238 | 64 | 9 | 103 | 10 | 105 | 24 |
| AL-DP-6239 | 9 | 1 | 20 | 4 | 31 | 11 |
| AL-DP-6240 | 99 | 7 | 139 | 16 | 194 | 43 |
| AL-DP-6241 | 43 | 9 | 54 | 12 | 66 | 19 |
| AL-DP-6242 | 6 | 1 | 15 | 7 | 36 | 8 |
| AL-DP-6243 | 7 | 2 | 19 | 5 | 33 | 13 |
| AL-DP-6244 | 7 | 2 | 19 | 3 | 37 | 13 |
| AL-DP-6245 | 25 | 4 | 45 | 10 | 58 | 9 |
| AL-DP-6246 | 34 | 8 | 65 | 10 | 66 | 13 |
| AL-DP-6247 | 53 | 6 | 78 | 14 | 105 | 20 |
| AL-DP-6248 | 7 | 0 | 22 | 7 | 39 | 12 |
| AL-DP-6249 | 36 | 8 | 48 | 13 | 61 | 7 |

The nine siRNA duplexes that showed the greatest growth inhibition in Table 5 were re-tested at a range of siRNA concentrations in HeLa cells. The siRNA concentrations tested were 100 nM, 33.3 nM, 11.1 nM, 3.70 nM, 1.23 nM, 0.41 nM, 0.14 nM and 0.046 nM. Assays were performed in sextuplicate, and the concentration of each siRNA resulting in fifty percent inhibition of cell proliferation ($IC_{50}$) was calculated. This dose-response analysis was performed between two and four times for each duplex. Mean $IC_{50}$ values (nM) are given in Table 6.

TABLE 6

IC50 of siRNA: cell proliferation in HeLa cells

| Duplex | Mean $IC_{50}$ |
|---|---|
| AL-DP-6226 | 15.5 |
| AL-DP-6229 | 3.4 |
| AL-DP-6231 | 4.2 |
| AL-DP-6232 | 17.5 |
| AL-DP-6239 | 4.4 |
| AL-DP-6242 | 5.2 |
| AL-DP-6243 | 2.6 |
| AL-DP-6244 | 8.3 |
| AL-DP-6248 | 1.9 |

Example 3

Eg5 siRNA in Vitro Screening Via mRNA Inhibition

Directly before transfection, HeLa S3 (ATCC-Number: CCL-2.2, LCG Promochem GmbH, Wesel, Germany) cells were seeded at $1.5 \times 10^4$ cells/well on 96-well plates (Greiner Bio-One GmbH, Frickenhausen, Germany) in 75 µl of growth medium (Ham's F12, 10% fetal calf serum, 100 u penicillin/100 µg/ml streptomycin, all from Bookroom AG, Berlin, Germany). Transfections were performed in quadruplicates. For each well 0.5 µl Lipofectamine-2000 (Invitrogen GmbH, Karlsruhe, Germany) were mixed with 12 µl Opti-MEM (Invitrogen) and incubated for 15 min at room temperature. For the siRNA concentration being 50 nM in the 100 µl transfection volume, 1 µl of a 5 µM siRNA were mixed with 11.5 µl Opti-MEM per well, combined with the Lipofectamine-2000-Opti-MEM mixture and again incubated for 15 minutes at room temperature. siRNA-Lipofectamine-2000-complexes were applied completely (25 µl each per well) to the cells and cells were incubated for 24 h at 37° C. and 5% $CO_2$ in a humidified incubator (Heroes GmbH, Hanau). The single dose screen was done once at 50 nM and at 25 nM, respectively.

Cells were harvested by applying 50 µl of lysis mixture (content of the QuantiGene bDNA-kit from Genospectra, Fremont, USA) to each well containing 100 µl of growth medium and were lysed at 53° C. for 30 min. Afterwards, 50 µl of the lists were incubated with probesets specific to human Eg5 and human GAPDH and proceeded according to the manufacturer's protocol for QuantiGene. In the end chemoluminescence was measured in a Victor2-Light (Perkin Elmer, Wiesbaden, Germany) as RLUs (relative light units) and values obtained with the hEg5 probeset were normalized to the respective GAPDH values for each well. Values obtained with siRNAs directed against Eg5 were related to the value obtained with an unspecific siRNA (directed against HCV) which was set to 100% (Tables 1b, 2b and 3b).

Effective siRNAs from the screen were further characterized by dose response curves.

Transfections of dose response curves were performed at the following concentrations: 100 nM, 16.7 nM, 2.8 nM, 0.46 nM, 77 picoM, 12.8 picoM, 2.1 picoM, 0.35 picoM, 59.5 fM, 9.9 fM and mock (no siRNA) and diluted with Opti-MEM to a final concentration of 12.5 µl according to the above protocol. Data analysis was performed by using the Microsoft Excel add-in software XL-fit 4.2 (IDBS, Guildford, Surrey, UK) and applying the dose response model number 205 (Tables 1b, 2b and 3b).

The lead siRNA AD 12115 was additionally analyzed by applying the WST-proliferation assay from Roche (as previously described).

A subset of 34 duplexes from Table 2 that showed greatest activity was assayed by transfection in HeLa cells at final concentrations ranging from 100 nM to 10 fM. Transfections were performed in quadruplicate. Two dose-response assays were performed for each duplex. The concentration giving 20% (IC20), 50% (IC50) and 80% (IC80) reduction of KSP mRNA was calculated for each duplex (Table 7).

TABLE 7

Dose response mRNA inhibition of Eg5/KSP duplexes in HeLa cells
Concentrations given in pM

| Duplex name | IC20s 1st screen | IC20s 2nd screen | IC50s 1st screen | IC50s 2nd screen | IC80s 1st screen | IC80s 2nd screen |
|---|---|---|---|---|---|---|
| AD12077 | 1.19 | 0.80 | 6.14 | 10.16 | 38.63 | 76.16 |
| AD12078 | 25.43 | 25.43 | 156.18 | 156.18 | ND | ND |
| AD12085 | 9.08 | 1.24 | 40.57 | 8.52 | 257.68 | 81.26 |
| AD12095 | 1.03 | 0.97 | 9.84 | 4.94 | 90.31 | 60.47 |
| AD12113 | 4.00 | 5.94 | 17.18 | 28.14 | 490.83 | 441.30 |
| AD12115 | 0.60 | 0.41 | 3.79 | 3.39 | 23.45 | 23.45 |
| AD12125 | 31.21 | 22.02 | 184.28 | 166.15 | 896.85 | 1008.11 |
| AD12134 | 2.59 | 5.51 | 17.87 | 22.00 | 116.36 | 107.03 |
| AD12149 | 0.72 | 0.50 | 4.51 | 3.91 | 30.29 | 40.89 |
| AD12151 | 0.53 | 6.84 | 4.27 | 10.72 | 22.88 | 43.01 |
| AD12152 | 155.45 | 7.56 | 867.36 | 66.69 | 13165.27 | ND |
| AD12157 | 0.30 | 26.23 | 14.60 | 92.08 | 14399.22 | 693.31 |
| AD12166 | 0.20 | 0.93 | 3.71 | 3.86 | 46.28 | 20.59 |
| AD12180 | 28.85 | 28.85 | 101.06 | 101.06 | 847.21 | 847.21 |
| AD12185 | 2.60 | 0.42 | 15.55 | 13.91 | 109.80 | 120.63 |
| AD12194 | 2.08 | 1.11 | 5.37 | 5.09 | 53.03 | 30.92 |
| AD12211 | 5.27 | 4.52 | 11.73 | 18.93 | 26.74 | 191.07 |
| AD12257 | 4.56 | 5.20 | 21.68 | 22.75 | 124.69 | 135.82 |
| AD12280 | 2.37 | 4.53 | 6.89 | 20.23 | 64.80 | 104.82 |
| AD12281 | 8.81 | 8.65 | 19.68 | 42.89 | 119.01 | 356.08 |
| AD12282 | 7.71 | 456.42 | 20.09 | 558.00 | ND | ND |
| AD12285 | ND | 1.28 | 57.30 | 7.31 | 261.79 | 42.53 |
| AD12292 | 40.23 | 12.00 | 929.11 | 109.10 | ND | ND |
| AD12252 | 0.02 | 18.63 | 6.35 | 68.24 | 138.09 | 404.91 |
| AD12275 | 25.76 | 25.04 | 123.89 | 133.10 | 1054.54 | 776.25 |
| AD12266 | 4.85 | 7.80 | 10.00 | 32.94 | 41.67 | 162.65 |
| AD12267 | 1.39 | 1.21 | 12.00 | 4.67 | 283.03 | 51.12 |
| AD12264 | 0.92 | 2.07 | 8.56 | 15.12 | 56.36 | 196.78 |
| AD12268 | 2.29 | 3.67 | 22.16 | 25.64 | 258.27 | 150.84 |
| AD12279 | 1.11 | 28.54 | 23.19 | 96.87 | 327.28 | 607.27 |
| AD12256 | 7.20 | 33.52 | 46.49 | 138.04 | 775.54 | 1076.76 |
| AD12259 | 2.16 | 8.31 | 8.96 | 40.12 | 50.05 | 219.42 |
| AD12276 | 19.49 | 6.14 | 89.60 | 59.60 | 672.51 | 736.72 |
| AD12321 | 4.67 | 4.91 | 24.88 | 19.43 | 139.50 | 89.49 |

(ND—not determined)

Example 4

Silencing of Liver Eg5/KSP in Juvenile Rats Following Single-Bolus Administration of LNP01 Formulated siRNA From birth until approximately 23 days of age, Eg5/KSP expression can be detected in the growing rat liver. Target silencing with a formulated Eg5/KSP siRNA was evaluated in juvenile rats using duplex AD-6248.

KSP Duplex Tested

| Duplex ID | Target | Sense | Antisense |
|---|---|---|---|
| AD6248 | KSP | AccGAAGuGuuGuuu GuccTsT (SEQ ID NO: 1238) | GGAcAAAcAAcACUUC GGUTsT (SEQ ID NO: 1239) |

Methods

Dosing of Animals.

Male, juvenile Sprague-Dawley rats (19 days old) were administered single doses of lipidoid ("LNP01") formulated siRNA via tail vein injection. Groups often animals received doses of 10 milligrams per kilogram (mg/kg) bodyweight of either AD6248 or an unspecific siRNA. Dose level refers to the amount of siRNA duplex administered in the formulation. A third group received phosphate-buffered saline. Animals were sacrificed two days after siRNA administration. Livers were dissected, flash frozen in liquid Nitrogen and pulverized into powders.

mRNA Measurements.

Levels of Eg5/KSP mRNA were measured in livers from all treatment groups. Samples of each liver powder (approximately ten milligrams) were homogenized in tissue lysis buffer containing proteinase K. Levels of Eg5/KSP and GAPDH mRNA were measured in triplicate for each sample using the Quantigene branched DNA assay (GenoSpectra). Mean values for Eg5/KSP were normalized to mean GAPDH values for each sample. Group means were determined and normalized to the PBS group for each experiment.

Statistical Analysis.

Significance was determined by ANOVA followed by the Tukey post-hoc test.

Results

Data Summary

Mean values (±standard deviation) for Eg5/KSP mRNA are given. Statistical significance (p value) versus the PBS group is shown (ns, not significant [p>0.05]).

TABLE 8

| | Experiment 1 | | |
|---|---|---|---|
| | | KSP/GAPDH | p value |
| PBS | | 1.0 ± 0.47 | |
| AD6248 | 10 mg/kg | 0.47 ± 0.12 | <0.001 |
| unspec | 10 mg/kg | 1.0 ± 0.26 | ns |

A statistically significant reduction in liver Eg5/KSP mRNA was obtained following treatment with formulated AD6248 at a dose of 10 mg/kg.

Example 5

Silencing of Rat Liver VEGF Following Intravenous Infusion of LNP01 Formulated VSP A "lipidoid" formulation comprising an equimolar mixture of two siRNAs was administered to rats. As used herein, VSP refers to a composition having two siRNAs, one directed to Eg5/KSP and one directed to VEGF. For this experiment the duplex AD3133 directed towards VEGF and AD12115 directed towards Eg5/KSP were used. Since Eg5/KSP expression is nearly undetectable in the adult rat liver, only VEGF levels were measured following siRNA treatment.

siRNA Duplexes Administered (VSP)

| Duplex ID | Target | Sense | Antisense |
|---|---|---|---|
| AD12115 | Eg5/KSP | ucGAGAAucuAAA cuAAcuTsT (SEQ ID NO: 1240) | AGUuAGUUuAGAU UCUCGATsT (SEQ ID NO: 1241) |
| AD3133 | VEGF | GcAcAuAGGAGA GAuGAGCUsU (SEQ ID NO: 1242) | AAGCUcAUCUCU CCuAuGuGCusG (SEQ ID NO: 1243) |

Key
A,G,C,U-ribonucleotides;
c,u-2'-O-Me ribonucleotides;
s-phosphorothioate.

Unmodified versions of each strand and the targets for each siRNA are as follows

| | | | |
|---|---|---|---|
| Eg5/KSP | unmod sense | 5' UCGAGAAUCUAAACUAACUTT 3' | SEQ ID NO: 1534 |
| | unmod antisense | 3' TTAGUCCUUAGAUUUGAUUGA 5' | SEQ ID NO: 1535 |
| | target | 5' UCGAGAAUCUAAACUAACU 3' | SEQ ID NO: 1311 |
| VEGF | unmod sense | 5' GCACAUAGGAGAGAUGAGCUU 3' | SEQ ID NO: 1536 |
| | unmod antisense | 3' GUCGUGUAUCCUCUCUACUCGAA 5' | SEQ ID NO: 1537 |
| | target | 5' GCACAUAGGAGAGAUGAGCUU 3' | SEQ ID NO: 1538 |

Methods

Dosing of animals. Adult, female Sprague-Dawley rats were administered lipidoid ("LNP01") formulated siRNA by a two-hour infusion into the femoral vein. Groups of four animals received doses of 5, 10 and 15 milligrams per kilogram (mg/kg) bodyweight of formulated siRNA. Dose level refers to the total amount of siRNA duplex administered in the formulation. A fourth group received phosphate-buffered saline. Animals were sacrificed 72 hours after the end of the siRNA infusion. Livers were dissected, flash frozen in liquid Nitrogen and pulverized into powders.

Formulation Procedure

The lipidoid ND98.4HCl (MW 1487) (Formula 1, above), Cholesterol (Sigma-Aldrich), and PEG-Ceramide C16 (Avanti Polar Lipids) were used to prepare lipid-siRNA nanoparticles. Stock solutions of each in ethanol were prepared: ND98, 133 mg/mL; Cholesterol, 25 mg/mL, PEG-Ceramide C16, 100 mg/mL. ND98, Cholesterol, and PEG-Ceramide C16 stock solutions were then combined in a 42:48:10 molar ratio. Combined lipid solution was mixed rapidly with aqueous siRNA (in sodium acetate pH 5) such that the final ethanol concentration was 35-45% and the final sodium acetate concentration was 100-300 mM. Lipid-siRNA nanoparticles formed spontaneously upon mixing. Depending on the desired particle size distribution, the resultant nanoparticle mixture was in some cases extruded through a polycarbonate membrane (100 nm cut-off) using a thermobarrel extruder (Lipex Extruder, Northern Lipids, Inc). In other cases, the extrusion step was omitted. Ethanol removal and simultaneous buffer exchange was accomplished by either dialysis or tangential flow filtration. Buffer was exchanged to phosphate buffered saline (PBS) pH 7.2.

Characterization of Formulations

Formulations prepared by either the standard or extrusion-free method are characterized in a similar manner. Formulations are first characterized by visual inspection.

They should be whitish translucent solutions free from aggregates or sediment. Particle size and particle size distribution of lipid-nanoparticles are measured by dynamic light scattering using a Malvern Zetasizer Nano ZS (Malvern, USA). Particles should be 20-300 nm, and ideally, 40-100 nm in size. The particle size distribution should be unimodal. The total siRNA concentration in the formulation, as well as the entrapped fraction, is estimated using a dye exclusion assay. A sample of the formulated siRNA is incubated with the RNA-binding dye Ribogreen (Molecular Probes) in the presence or absence of a formulation disrupting surfactant, 0.5% Triton-X100. The total siRNA in the formulation is determined by the signal from the sample containing the surfactant, relative to a standard curve. The entrapped fraction is determined by subtracting the "free" siRNA content (as measured by the signal in the absence of surfactant) from the total siRNA content. Percent entrapped siRNA is typically >85%. For SNALP formulation, the particle size is at least 30 nm, at least 40 nm, at least 50 nm, at least 60 nm, at least 70 nm, at least 80 nm, at least 90 nm, at least 100 nm, at least 110 nm, and at least 120 nm. The preferred range is about at least 50 nm to about at least 110 nm, preferably about at least 60 nm to about at least 100 nm, most preferably about at least 80 nm to about at least 90 nm. In one example, each of the particle size comprises at least about 1:1 ratio of Eg5 dsRNA to VEGF dsRNA.

mRNA Measurements.

Samples of each liver powder (approximately ten milligrams) were homogenized in tissue lysis buffer containing proteinase K. Levels of VEGF and GAPDH mRNA were measured in triplicate for each sample using the Quantigene branched DNA assay (GenoSpectra). Mean values for VEGF were normalized to mean GAPDH values for each sample. Group means were determined and normalized to the PBS group for each experiment.

Protein Measurements.

Samples of each liver powder (approximately 60 milligrams) were homogenized in 1 ml RIPA buffer. Total protein concentrations were determined using the Micro BCA protein assay kit (Pierce). Samples of total protein from each animal was used to determine VEGF protein levels using a VEGF ELISA assay (R&D systems). Group means were determined and normalized to the PBS group for each experiment.

Statistical Analysis.

Significance was determined by ANOVA followed by the Tukey post-hoc test

Results

Data Summary

Mean values (±standard deviation) for mRNA (VEGF/GAPDH) and protein (rel. VEGF) are shown for each treatment group. Statistical significance (p value) versus the PBS group for each experiment is shown.

TABLE 9

|  | VEGF/GAPDH | p value | rel VEGF | p value |
| --- | --- | --- | --- | --- |
| PBS | 1.0 ± 0.17 |  | 1.0 ± 0.17 |  |
| 5 mg/kg | 0.74 ± 0.12 | <0.05 | 0.23 ± 0.03 | <0.001 |
| 10 mg/kg | 0.65 ± 0.12 | <0.005 | 0.22 ± 0.03 | <0.001 |
| 15 mg/kg | 0.49 ± 0.17 | <0.001 | 0.20 ± 0.04 | <0.001 |

Statistically significant reductions in liver VEGF mRNA and protein were measured at all three siRNA dose levels.

Example 6

Assessment of VSP SNALP in Mouse Models of Human Hepatic Tumors

These studies utilized a VSP siRNA cocktail containing dsRNAs targeting KSP/Eg5 and dsRNAs targeting VEGF. As used herein, VSP refers to a composition having two siRNAs, one directed to Eg5/KSP and one directed to VEGF. For this experiment the duplexes AD3133 (directed towards VEGF) and AD12115 (directed towards Eg5/KSP) were used. The siRNA cocktail was formulated in SNALPs.

The maximum study size utilized 20-25 mice. To test the efficacy of the siRNA SNALP cocktail to treat liver cancer, $1 \times 10^6$ tumor cells were injected directly into the left lateral lobe of test mice. The incisions were closed by sutures, and the mice allowed to recover for 2-5 hours. The mice were fully recovered within 48-72 hours. The SNALP siRNA treatment was initiated 8-11 days after tumor seeding.

The SNALP formulations utilized were (i) VSP (KSP+VEGF siRNA cocktail (1:1 molar ratio)); (ii) KSP (KSP+Luc siRNA cocktail); and (iii) VEGF (VEGF+Luc siRNA cocktail). All formulations contained equal amounts (mg) of each active siRNA. All mice received a total siRNA/lipid dose, and each cocktail was formulated into 1:57 cDMA SNALP (1.4% PEG-cDMA; 57.1% DLinDMA; 7.1% DPPC; and 34.3% cholesterol), 6:1 lipid:drug using original citrate buffer conditions.

Human Hep3B Study A: Anti-Tumor Activity of VSP-SNALP

Human Hepatoma Hep3B tumors were established in scid/beige mice by intrahepatic seeding. Group A (n=6) animals were administered PBS; Group B (n=6) animals were administered VSP SNALP; Group C (n=5) animals were administered KSP/Luc SNALP; and Group D (n=5) animals were administered VEGF/Luc SNALP.

SNALP treatment was initiated eight days after tumor seeding. The SNALP was dosed at 3 mg/kg total siRNA, twice weekly (Monday and Thursday), for a total of six doses (cumulative 18 mg/kg siRNA). The final dose was administered at day 25, and the terminal endpoint of the study was at day 27.

Tumor burden was assayed by (a) body weight; (b) liver weight; (c) visual inspection+photography at day 27; (d) human-specific mRNA analysis; and (e) blood alpha-fetoprotein levels measured at day 27.

Table 10 below illustrates the results of visual scoring of tumor burden measured in the seeded (left lateral) liver lobe. Score: "−"=no visible tumor; "+"=evidence of tumor tissue at injection site; "++"=Discrete tumor nodule protruding from liver lobe; "+++"=large tumor protruding on both sides of liver lobe; "++++"=large tumor, multiple nodules throughout liver lobe.

TABLE 10

|  | Mouse | Tumor Burden |
| --- | --- | --- |
| Group A: PBS, day 27 | 1 | ++++ |
|  | 2 | ++++ |
|  | 3 | ++ |
|  | 4 | +++ |
|  | 5 | ++++ |
|  | 6 | ++++ |
| Group B: VSP (VEGF + KSP/Eg5, d. 27 | 1 | + |
|  | 2 | − |
|  | 3 | − |
|  | 4 | − |
|  | 5 | ++ |
|  | 6 | − |
| Group C: KSP (Luc + KSP), d. 27 | 1 | + |
|  | 2 | ++ |
|  | 3 | − |
|  | 4 | + |
|  | 5 | ++ |
| Group D: VEGF (Luc + VEGF), d. 27 | 1 | ++++ |
|  | 2 | − |
|  | 3 | ++++ |
|  | 4 | +++ |
|  | 5 | ++++ |

Liver weights, as percentage of body weight, are shown in FIG. 1.

Body weights are shown in FIGS. 2A-2D.

From this study, the following conclusions were made. (1) VSP SNALP demonstrated potent anti-tumor effects in Hep3B 1H model; (2) the anti-tumor activity of the VSP cocktail appeared largely associated with the KSP component; (3) anti-KSP activity was confirmed by single dose histological analysis; and (4) VEGF siRNA showed no measurable effect on inhibition of tumor growth in this model.

Human Hep3B Study B: Prolonged Survival with VSP Treatment

In a second Hep3B study, human hepatoma Hep3B tumors were established by intrahepatic seeding into scid/beige mice. These mice were deficient for lymphocytes and natural killer (NK) cells, which is the minimal scope for immune-mediated anti-tumor effects. Group A (n=6) mice were untreated; Group B (n=6) mice were administered luciferase (luc) 1955 SNALP (Lot No. AP10-02); and Group C (n=7) mice were administered VSP SNALP (Lot No. AP10-01). SNALP was 1:57 cDMA SNALP, and 6:1 lipid:drug.

SNALP treatment was initiated eight days after tumor seeding. SNALP was dosed at 3 mg/kg siRNA, twice weekly (Mondays and Thursdays), for a total of six doses (cumulative 18 mg/kg siRNA). The final dose was delivered at day 25, and the terminal endpoint of the study was at day 27.

Tumor burden was assayed by (1) body weight; (2) visual inspection+photography at day 27; (3) human-specific mRNA analysis; and (4) blood alpha-fetoprotein measured at day 27.

Figure 3:
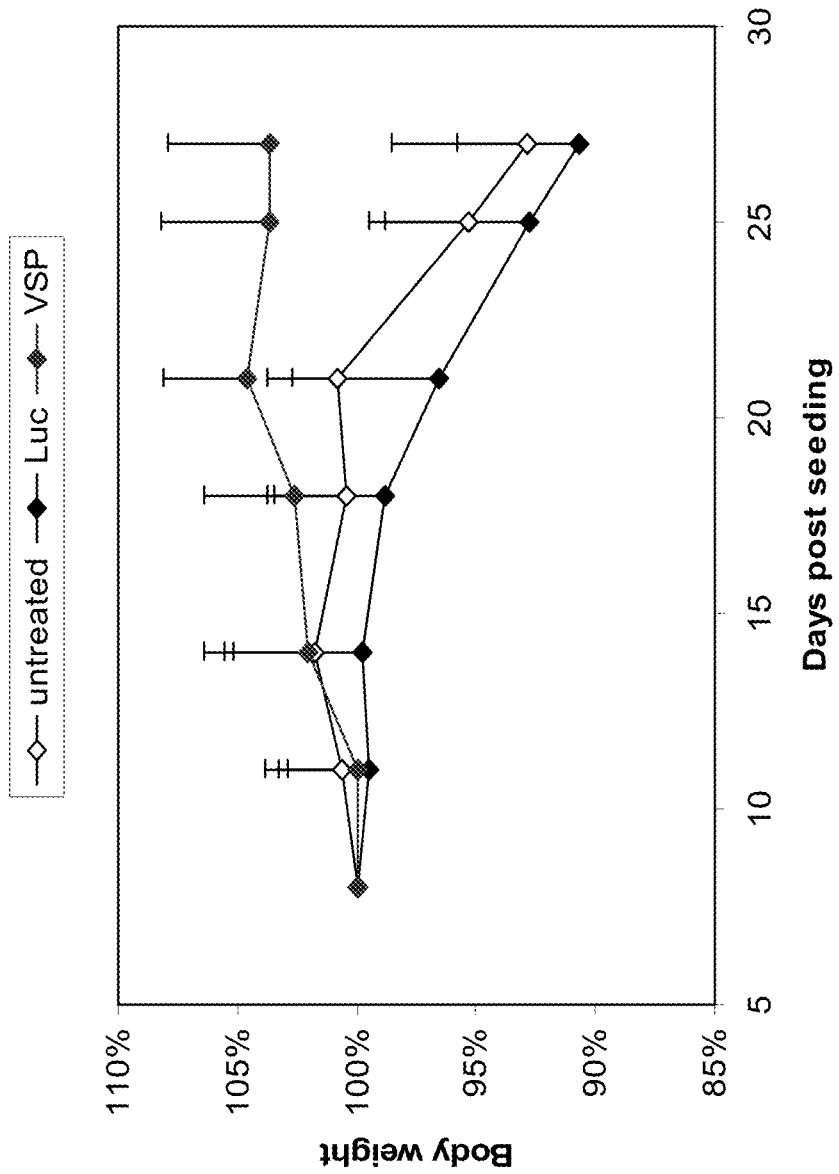
FIG. 3 is a graph showing the effects of SNALP-siRNAs on body weight in a Hep3B mouse model.

Body weights were measured at each day of dosing (days 8, 11, 14, 18, 21, and 25) and on the day of sacrifice (FIG. 3).

TABLE 11

|  | Mouse | Tumor Burden by macroscopic observation |
| --- | --- | --- |
| Group A: untreated, day 27 | A1R | ++ |
|  | A1G | ++++ |
|  | A1W | − |
|  | A2R | ++++ |
|  | A2G | +++ |
|  | A2W | ++++ |

TABLE 11-continued

|  | Mouse | Tumor Burden by macroscopic observation |
|---|---|---|
| Group B: | B1R | ++++ |
| 1955 Luc SNALP, day 27 | B1G | ++++ |
|  | B1W | +++ |
|  | B2R | ++ |
|  | B2G | +++ |
|  | B2W | ++++ |
| Group C: | C1R | − |
| VSP SNALP, day 27 | C1G | − |
|  | C1B | − |
|  | C1W | + |
|  | C2R | + |
|  | C2G | + |
|  | C2W | − |

Score: "−"=no visible tumor; "+"=evidence of tumor tissue at injection site; "++"=Discrete tumor nodule protruding from liver lobe; "+++"=large tumor protruding on both sides of liver lobe; "++++"=large tumor, multiple nodules throughout liver lobe.

Figure 4:
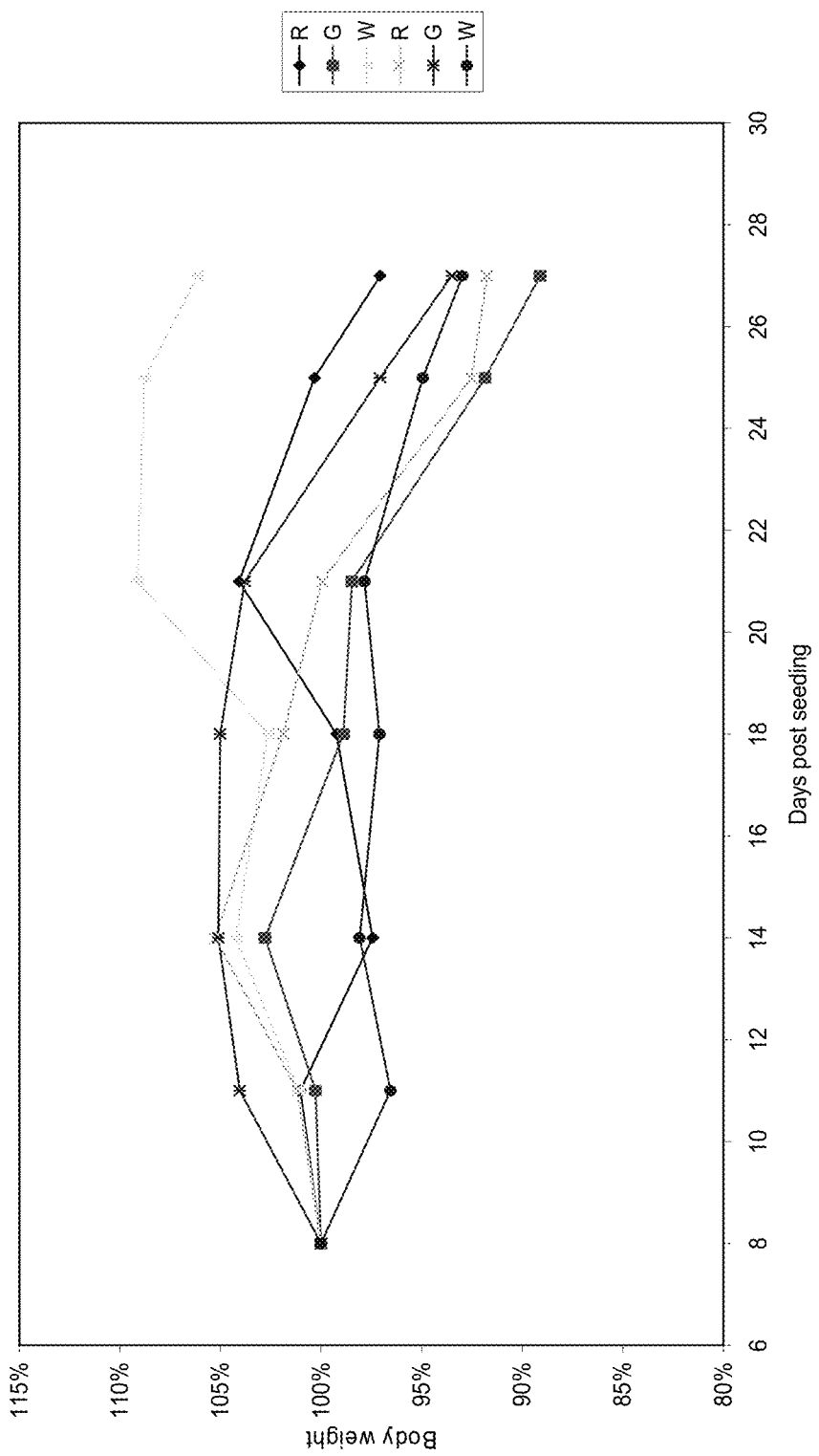
FIG. 4 is a graph showing the body weight in untreated control animals.
Figure 5:
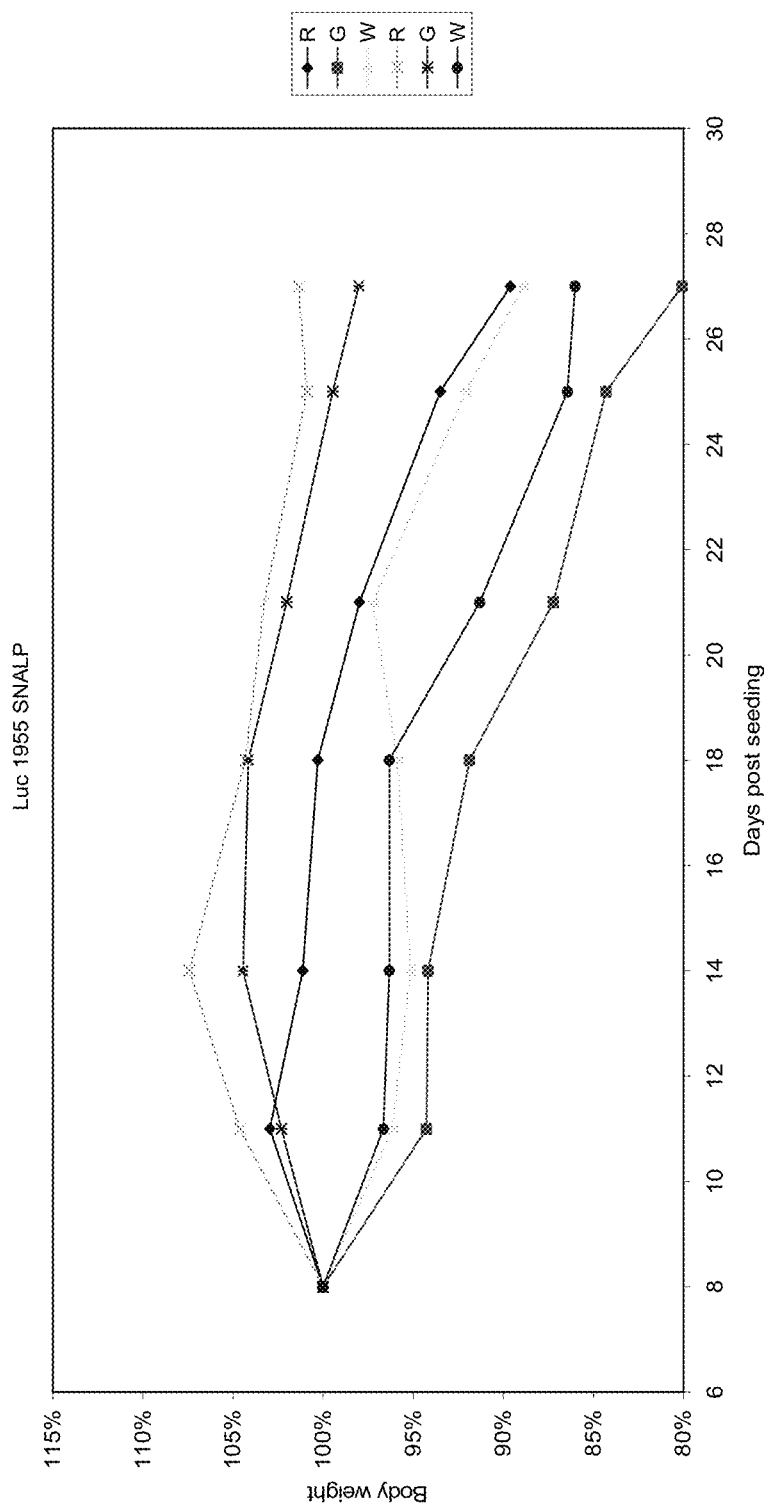
FIG. 5 is a graph showing the effects of control luciferase-SNALP siRNAs on body weight in a Hep3B mouse model.
Figure 6:
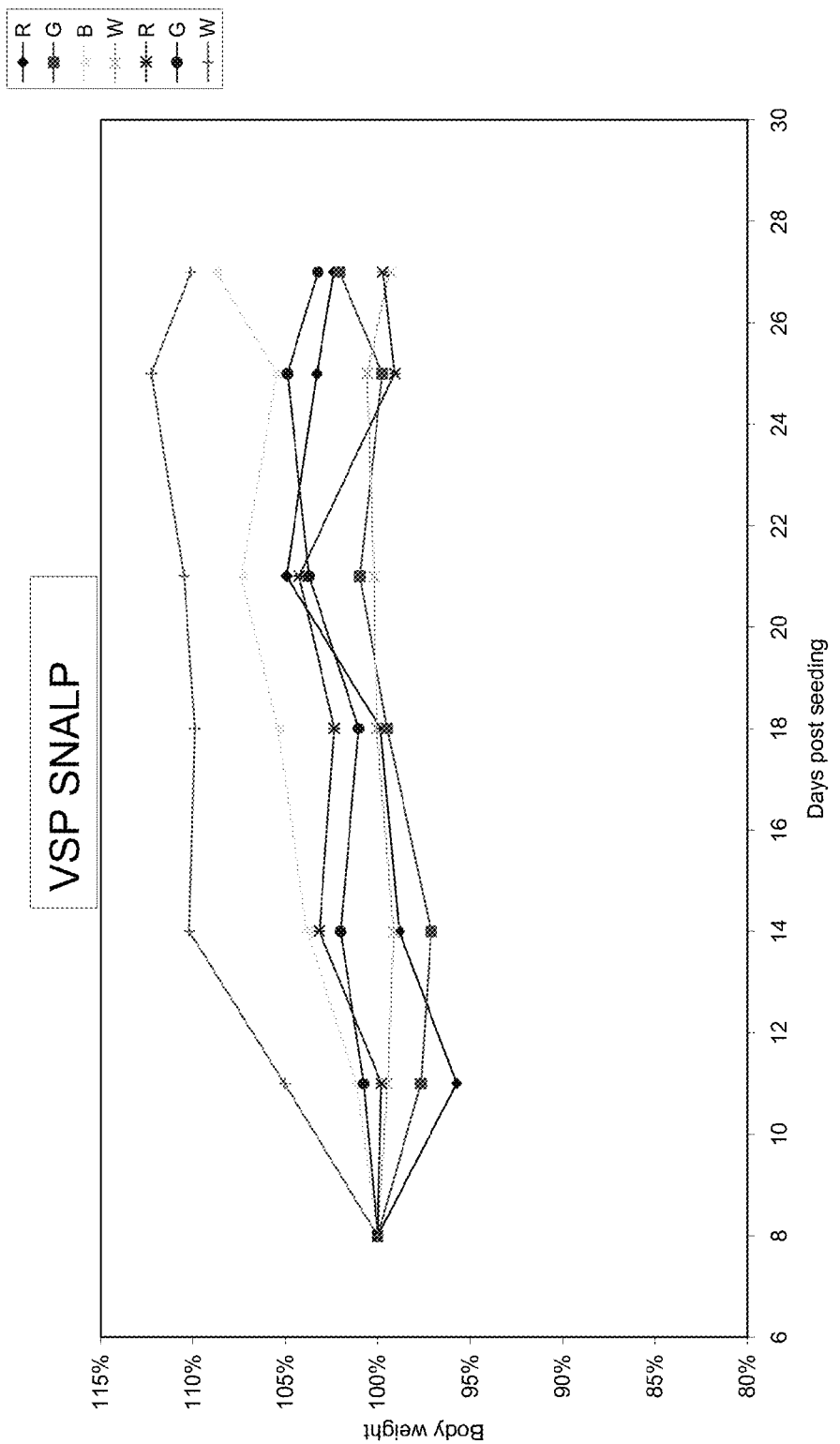
FIG. 6 is a graph showing the effects of VSP-SNALP siRNAs on body weight in a Hep3B mouse model.

The correlation between body weights and tumor burden are shown in FIGS. 4, 5 and 6.

A single dose of VSP SNALP (2 mg/kg) to Hep3B mice also resulted in the formation of mitotic spindles in liver tissue samples examined by histological staining.

Figure 7A:
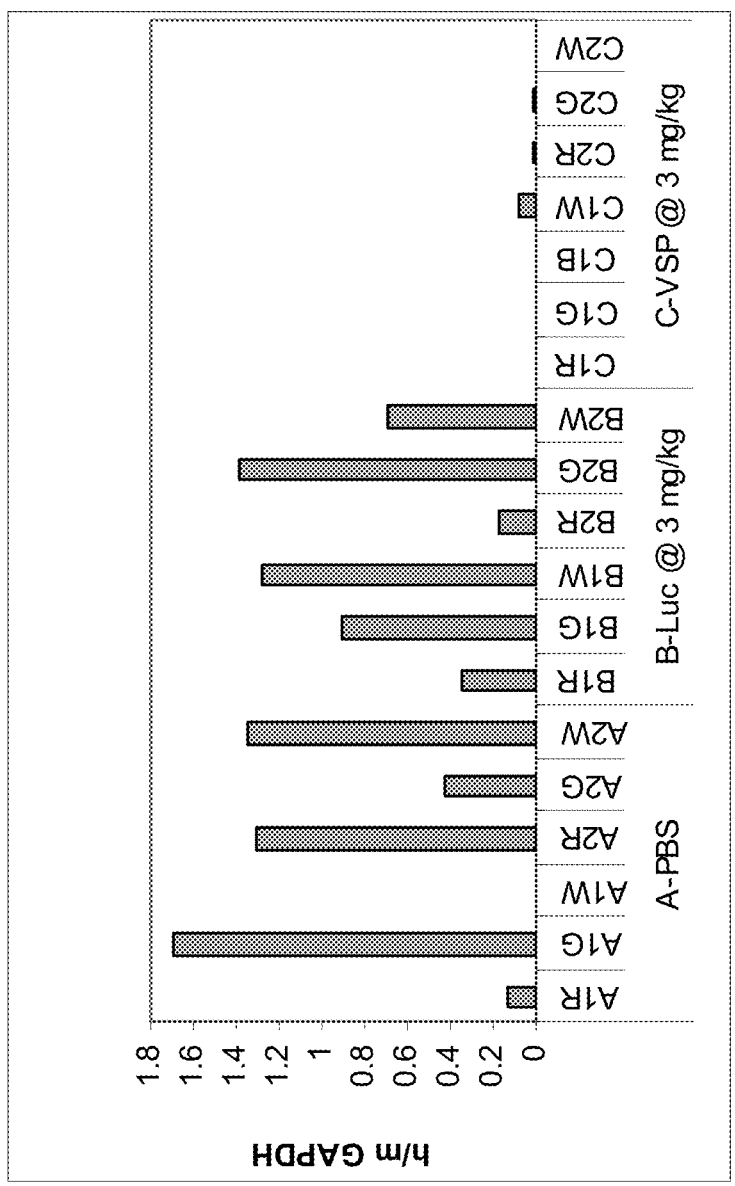
FIG. 7A is a graph showing the effects of SNALP-siRNAs on human GAPDH levels normalized to mouse GAPDH levels in a Hep3B mouse model.

Tumor burden was quantified by quantitative RT-PCR (pRT-PCR) (Taqman). Human GAPDH was normalized to mouse GAPDH via species-specific Taqman assays. Tumor score as shown by macroscopic observation in the table above correlated with GADPH levels (FIG. 7A).

Figure 7B:
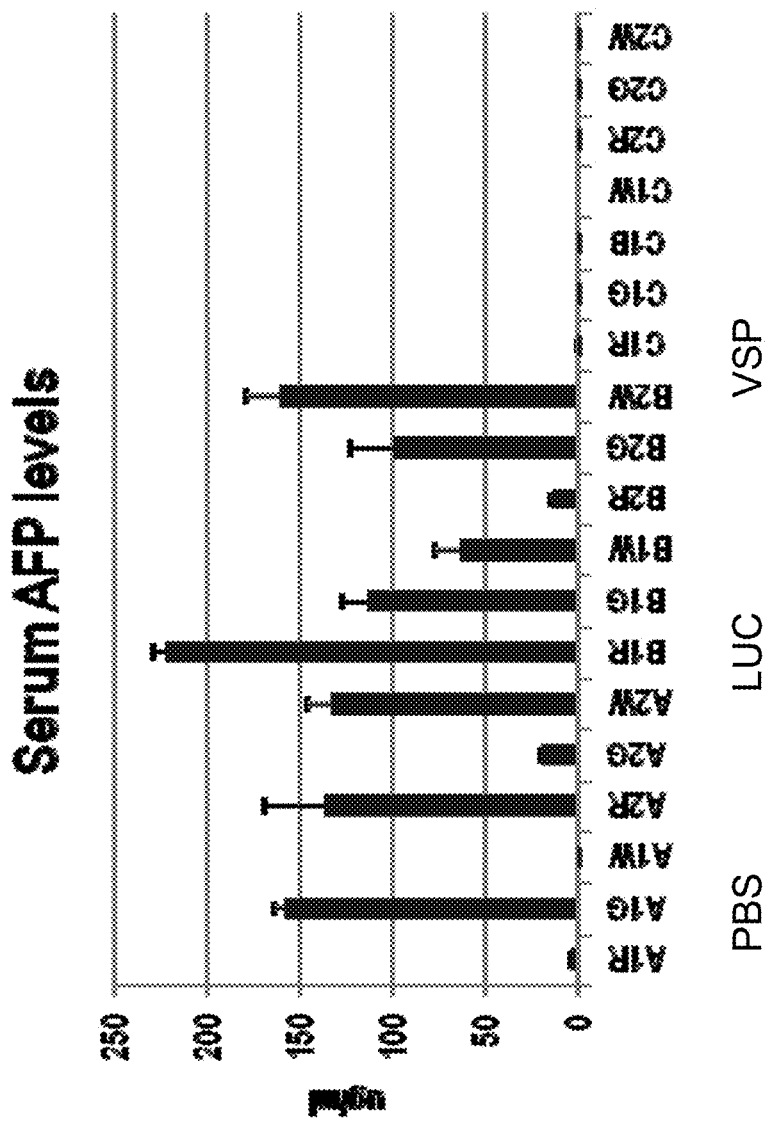
FIG. 7B is a graph showing the effects of SNALP-siRNAs on serum AFP levels as measured by serum ELISA in a Hep3B mouse model.

Serum ELISA was performed to measure alpha-fetoprotein (AFP) secreted by the tumor. As described below, if levels of AFP go down after treatment, the tumor is not growing. Treatment with VSP lowered AFP levels in some animals compared to treatment with controls (FIG. 7B).

Human HepB3 Study C:

In a third study, human HCC cells (HepB3) were injected directly into the liver of SCID/beige mice, and treatment was initiated 20 days later. Group A animals were administered PBS; Group B animals were administered 4 mg/kg Luc-1955 SNALP; Group C animals were administered 4 mg/kg SNALP-VSP; Group D animals were administered 2 mg/kg SNALP-VSP; and Group E animals were administered 1 mg/kg SNALP-VSP. Treatment was with a single intravenous (iv) dose, and mice were sacrificed 24 hr. later.

Figure 8:
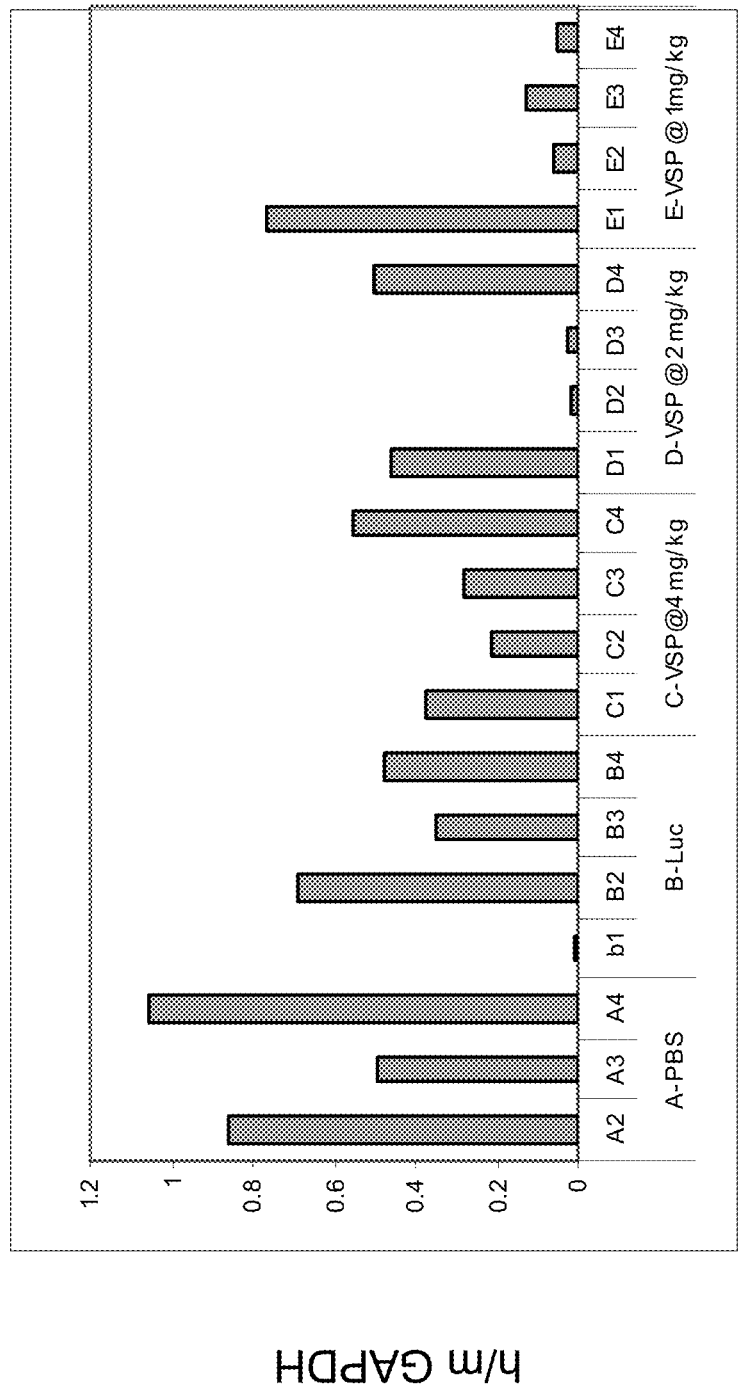
FIG. 8 is a graph showing the effects of SNALP-siRNAs on human GAPDH levels normalized to mouse GAPDH levels in a Hep3B mouse model.

Tumor burden and target silencing was assayed by qRT-PCR (Taqman). Tumor score was also measured visually as described above, and the results are shown in the following table. hGAPDH levels, as shown in FIG. 8, correlates with macroscopic tumor score as shown in the table below.

TABLE 12

|  | Mouse | Tumor Burden by macroscopic observation |
|---|---|---|
| Group A: PBS | A2 | +++ |
|  | A3 | +++ |
|  | A4 | +++ |
| Group B: 4 mg/kg Luc-1955 SNALP | B1 | + |
|  | B2 | +++ |
|  | B3 | +++ |
|  | B4 | +++ |
| Group C: 4 mg/kg SNALP-VSP | C1 | ++ |
|  | C2 | ++ |
|  | C3 | ++ |
|  | C4 | +++ |
| Group D: 2 mg/kg SNALP-VSP | D1 | ++ |
|  | D2 | + |
|  | D3 | + |
|  | D4 | ++ |
| Group E: 1 mg/kg SNALP-VSP | E1 | +++ |
|  | E2 | + |
|  | E3 | ++ |
|  | E4 | + |

Figure 9:
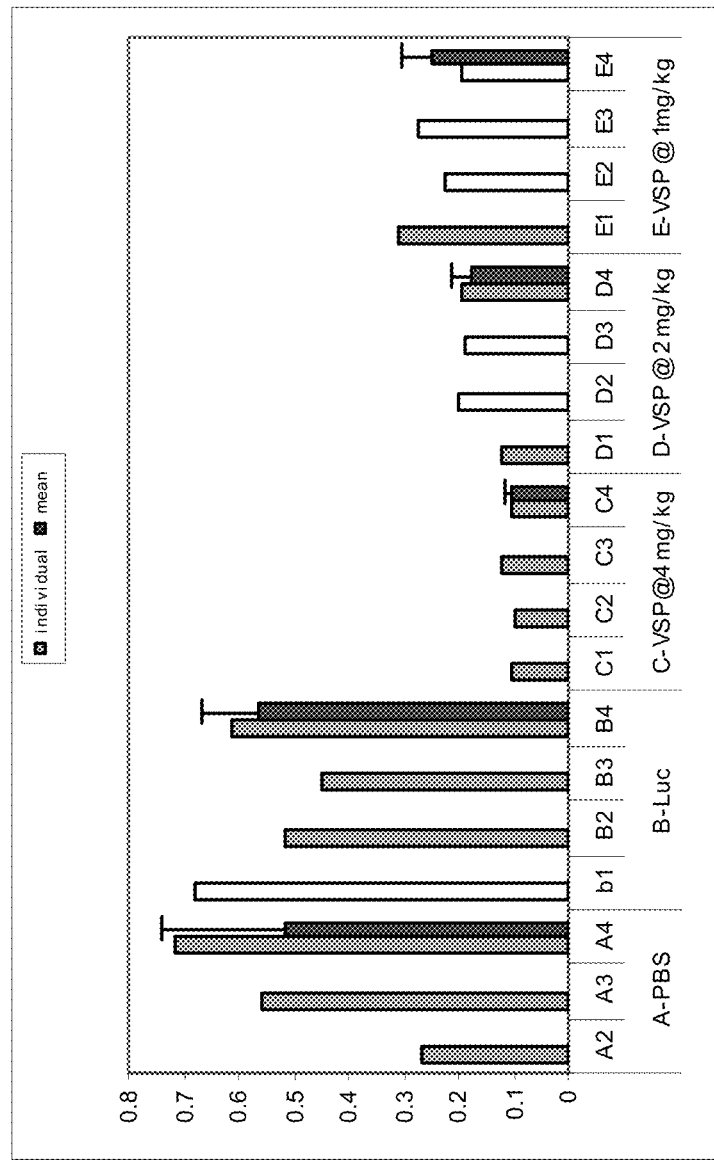
FIG. 9 is a graph showing the effects of SNALP-siRNAs on human KSP levels normalized to human GAPDH levels in a Hep3B mouse model.
Figure 10:
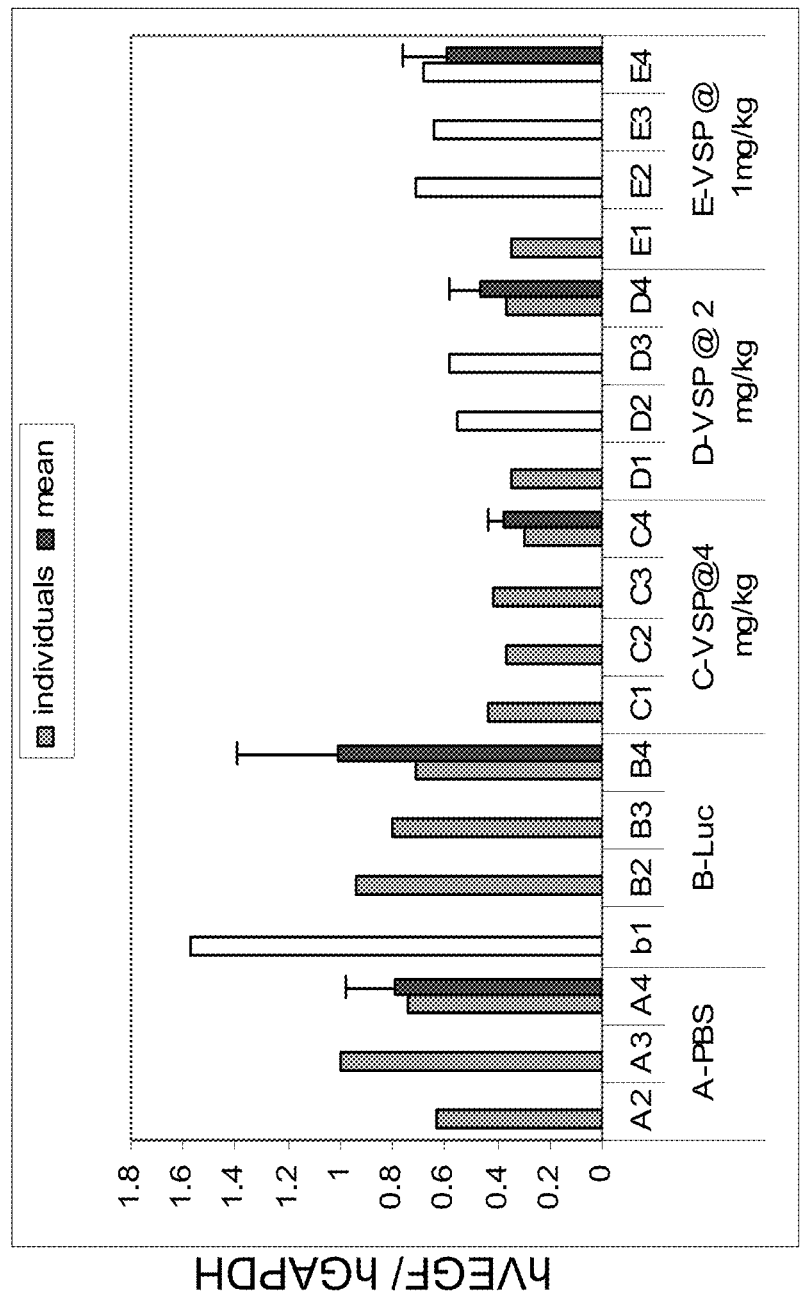
FIG. 10 is a graph showing the effects of SNALP-siRNAs on human VEGF levels normalized to human GAPDH levels in a Hep3B mouse model.

Score:
"+" = variable tumor take/some small tumors;
"++" = Discrete tumor nodule protruding from liver lobe;
"+++" = large tumor protruding on both sides of liver lobe Human (tumor-derived) KSP silencing was assayed by Taqman analysis and the results are shown in FIG. 10. hKSP expression was normalized to hGAPDH. About 80% tumor KSP silencing was observed at 4 mg/kg SNALP-VSP, and efficacy was evident at 1 mg/kg. The clear bars in FIG. 9 represent the results from small (low GAPDH) tumors.

Human (tumor-derived) VEGF silencing was assayed by Taqman analysis and the results are shown in FIG. 10. hVEGF expression was normalized to hGAPDH. About 60% tumor VEGF silencing was observed at 4 mg/kg SNALP-VSP, and efficacy was evident at 1 mg/kg. The clear bars in FIG. 10 represent the results from small (low GAPDH) tumors.

Figure 11A:
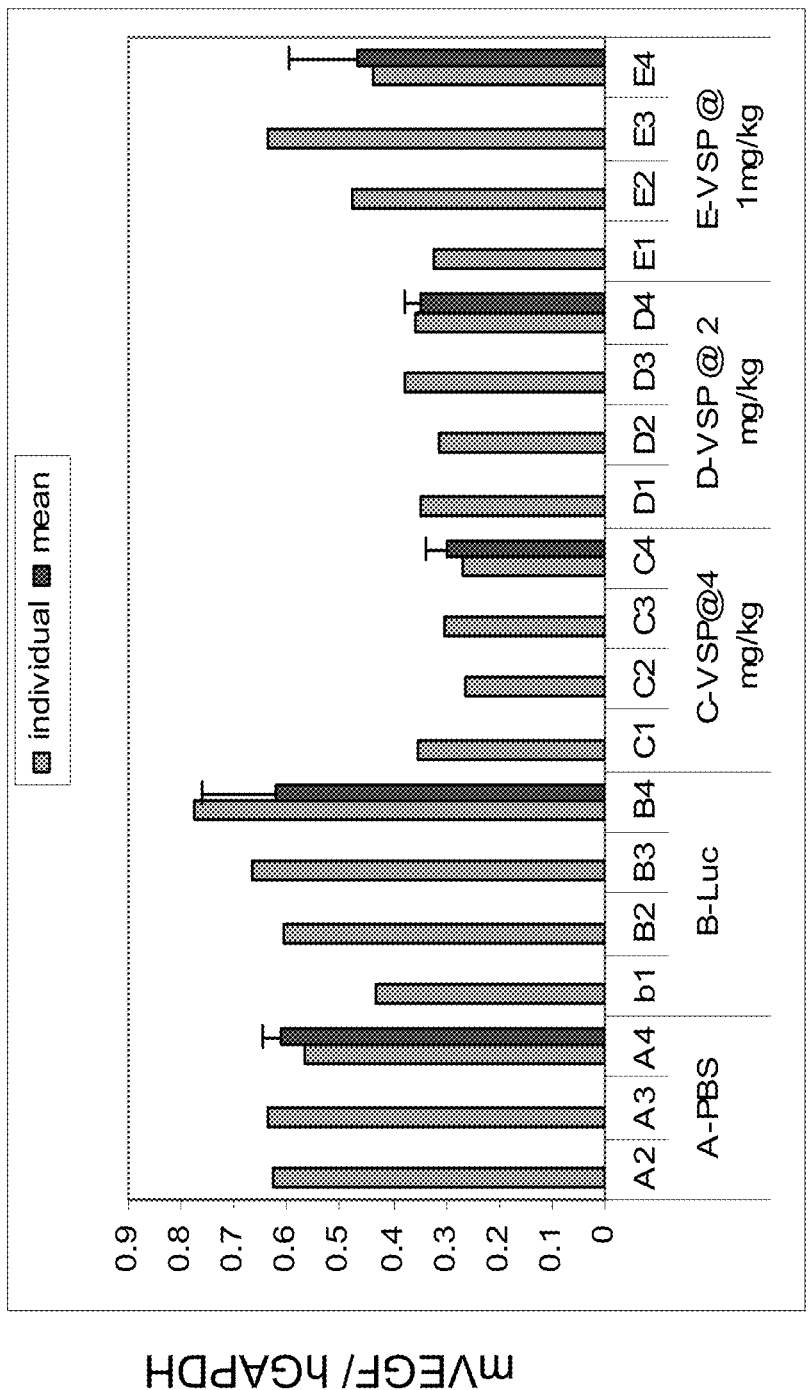
FIG. 11A is a graph showing the effects of SNALP-siRNAs on mouse VEGF levels normalized to human GAPDH levels in a Hep3B mouse model.

Mouse (liver-derived) VEGF silencing was assayed by Taqman analysis and the results are shown in FIG. 11A. mVEGF expression was normalized to hGAPDH. About 50% liver VEGF silencing was observed at 4 mg/kg SNALP-VSP, and efficacy was evident at 1 mg/kg.

Human HepB3 Study D: Contribution of Each dsRNA to Tumor Growth

In a fourth study, human HCC cells (HepB3) were injected directly into the liver of SCID/beige mice, and treatment was initiated 8 days later. Treatment was with intravenous (iv) bolus injections, twice weekly, for a total of six does. The final dose was administered at day 25, and the terminal endpoint was at day 27.

Tumor burden was assayed by gross histology, human-specific mRNA analysis (hGAPDH qPCR), and blood alpha-fetoprotein levels (serum AFP via ELISA).

In Study 1, Group A was treated with PBS, Group B was treated with SNALP-KSP+Luc (3 mg/kg), Group C was treated with SNALP-VEGF+Luc (3 mg/kg), and Group D was treated with ALN-VSP02 (3 mg/kg).

In Study 2, Group A was treated with PBS; Group B was treated with SNALP-KSP+Luc (1 mg/kg), Group C was treated with ALN-VSP02 (1 mg/kg).

Both GAPDH mRNA levels and serum AFP levels were shown to decrease after treatment with ALN-VSP02 (FIG. 11B).

Histology Studies:

Human hepatoma Hep3B tumors were established by intrahepatic seeding in mice. SNALP treatment was initiated 20 days after tumor seeding. Tumor-bearing mice (three per group) were treated with a single intravenous (IV) dose of (i) VSP SNALP or (ii) control (Luc) SNALP at 2 mg/kg total siRNA.

Liver/tumor samples were collected for conventional H&E histology 24 hours after single SNALP administration.

Large macroscopic tumor nodules (5-10 mm) were evident at necroscopy.

Figure 12B:
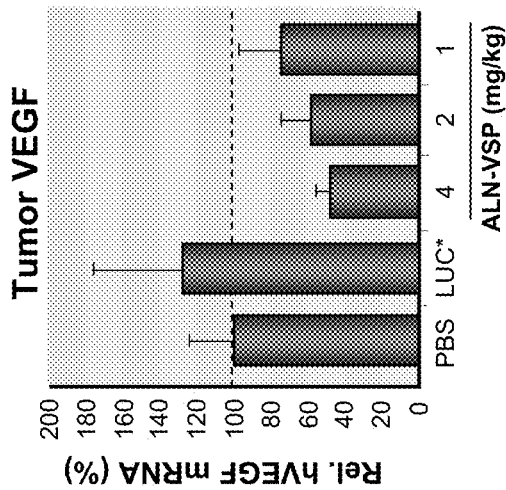
Figure 12A:
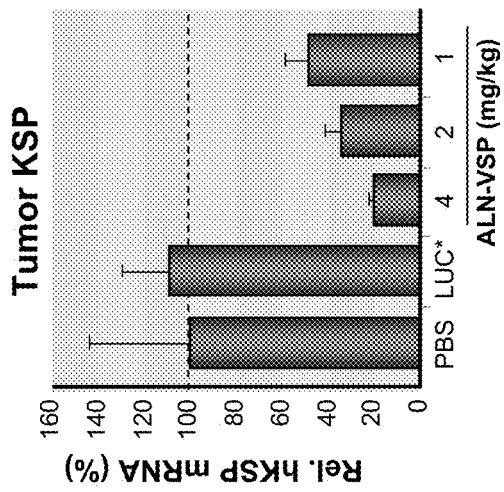

Effect of ALN-VSP in Hep3B Mice:

ALN-VSP (a cocktail of KSP dsRNA and VEGF dsRNA) treatment reduced tumor burden and expression of tumor-derived KSP and VEGF. GAPDH mRNA levels, a measure of tumor burden, were also observed to decline following administration of ALN-VSP dsRNA (see FIGS. 12A-12C). A decrease in tumor burden by visual macroscopic observation was also evident following administration of ALN-VSP.

A single IV bolus injection of ALN-VSP also resulted in mitotic spindle formation that was clearly detected in liver tissue samples from Hep3B mice. This observation indicated cell cycle arrest.

Example 7

Survival of SNALP-VSP Animals Versus SNALP-Luc Treated Animals

To test the effect of siRNA SNALP on survival rates of cancer subjects, tumors were established by intrahepatic seeding in mice and the mice were treated with SNALP-siRNA. These studies utilized a VSP siRNA cocktail containing dsRNAs targeting KSP/Eg5 and VEGF. Control was dsRNA targeting Luc. The siRNA cocktail was formulated in SNALPs.

Tumor cells (Human Hepatoma Hep3B, 1×10^6) were injected directly into the left lateral lobe of scid/beige mice. These mice were deficient for lymphocytes and natural killer (NK) cells, which is the minimal scope for immune-mediated anti-tumor effects. The incisions were closed by sutures, and the mice allowed to recover for 2-5 hours. The mice were fully recovered within 48-72 hours.

All mice received a total siRNA/lipid intravenous (iv) dose, and each cocktail was formulated into 1:57 cDMA SNALP (1.4% PEG-cDMA; 57.1% DLinDMA; 7.1% DPPC; and 34.3% cholesterol), 6:1 lipid:drug using original citrate buffer conditions.

siRNA-SNALP treatment was initiated on the day indicated below (18 or 26 days) after tumor seeding. siRNA-SNALP were administered twice a week for three weeks after 18 or 26 day is at a dose of 4 mg/kg. Survival was monitored and animals were euthanized based on humane surrogate endpoints (e.g., animal body weight, abdominal distension/discoloration, and overall health).

Figure 13A:
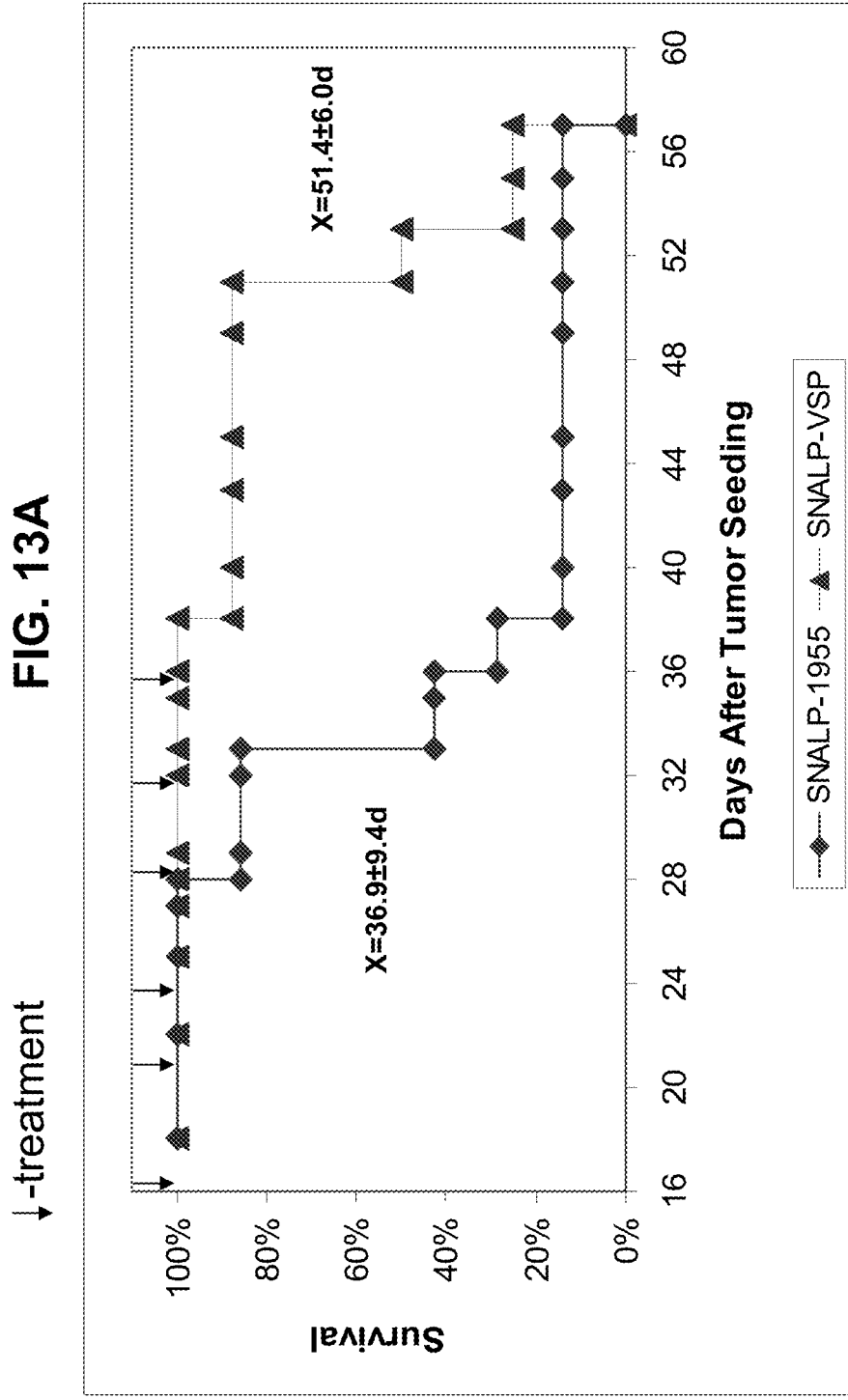
FIG. 13A and FIG. 13B are graphs showing the effects of SNALP-siRNAs on survival in mice with hepatic tumors. Treatment was started at 18 days (FIG. 13A) and 26 days (FIG. 13B) after tumor cell seeding.

The survival data for treatment initiated 18 days after tumor seeing is summarized in Table 13, Table 14, and FIG. 13A.

TABLE 13

Kaplan-Meier (survival) data (% Surviving)

| Day | SNALP-Luc | SNALP-VSP |
|---|---|---|
| 18 | 100% | 100% |
| 22 | 100% | 100% |
| 25 | 100% | 100% |
| 27 | 100% | 100% |
| 28 | 100% | 100% |
| 28 | 86% | 100% |
| 29 | 86% | 100% |
| 32 | 86% | 100% |
| 33 | 86% | 100% |
| 33 | 43% | 100% |
| 35 | 43% | 100% |
| 36 | 43% | 100% |

TABLE 13-continued

Kaplan-Meier (survival) data (% Surviving)

| Day | SNALP-Luc | SNALP-VSP |
|---|---|---|
| 36 | 29% | 100% |
| 38 | 29% | 100% |
| 38 | 14% | 100% |
| 38 | 14% | 88% |
| 40 | 14% | 88% |
| 43 | 14% | 88% |
| 45 | 14% | 88% |
| 49 | 14% | 88% |
| 51 | 14% | 88% |
| 51 | 14% | 50% |
| 53 | 14% | 50% |
| 53 | 14% | 25% |
| 55 | 14% | 25% |
| 57 | 14% | 25% |
| 57 | 0% | 0% |

TABLE 14

Survival in days, for each animal.

| Animal | Treatment group | Survival | |
|---|---|---|---|
| 1 | SNALP-Luc | 28 | days |
| 2 | SNALP-Luc | 33 | days |
| 3 | SNALP-Luc | 33 | days |
| 4 | SNALP-Luc | 33 | days |
| 5 | SNALP-Luc | 36 | days |
| 6 | SNALP-Luc | 38 | days |
| 7 | SNALP-Luc | 57 | days |
| 8 | SNALP-VSP | 38 | days |
| 9 | SNALP-VSP | 51 | days |
| 10 | SNALP-VSP | 51 | days |
| 11 | SNALP-VSP | 51 | days |
| 12 | SNALP-VSP | 53 | days |
| 13 | SNALP-VSP | 53 | days |
| 14 | SNALP-VSP | 57 | days |
| 15 | SNALP-VSP | 57 | days |

FIG. 13A shows the mean survival of SNALP-VSP animals and SNALP-Luc treated animals versus days after tumor seeding. The mean survival of SNALP-VSP animals was extended by approximately 15 days versus SNALP-Luc treated animals.

TABLE 15

Serum alpha fetoprotein (AFP) concentration, for each animal, at a time pre-treatment and at end of treatment (concentration in µg/ml)

| | | pre-Rx | End of Rx |
|---|---|---|---|
| 1 | SNALP-Luc | 30.858 | 454.454 |
| 2 | SNALP-Luc | 10.088 | 202.082 |
| 3 | SNALP-Luc | 23.736 | 648.952 |
| 4 | SNALP-Luc | 1.696 | 13.308 |
| 5 | SNALP-Luc | 4.778 | 338.688 |
| 6 | SNALP-Luc | 15.004 | 826.972 |
| 7 | SNALP-Luc | 11.036 | 245.01 |
| 8 | SNALP-VSP | 37.514 | 182.35 |
| 9 | SNALP-VSP | 91.516 | 248.06 |
| 10 | SNALP-VSP | 25.448 | 243.13 |
| 11 | SNALP-VSP | 24.862 | 45.514 |
| 12 | SNALP-VSP | 57.774 | 149.352 |
| 13 | SNALP-VSP | 12.446 | 78.724 |
| 14 | SNALP-VSP | 2.912 | 9.61 |
| 15 | SNALP-VSP | 4.516 | 11.524 |

Figure 14:
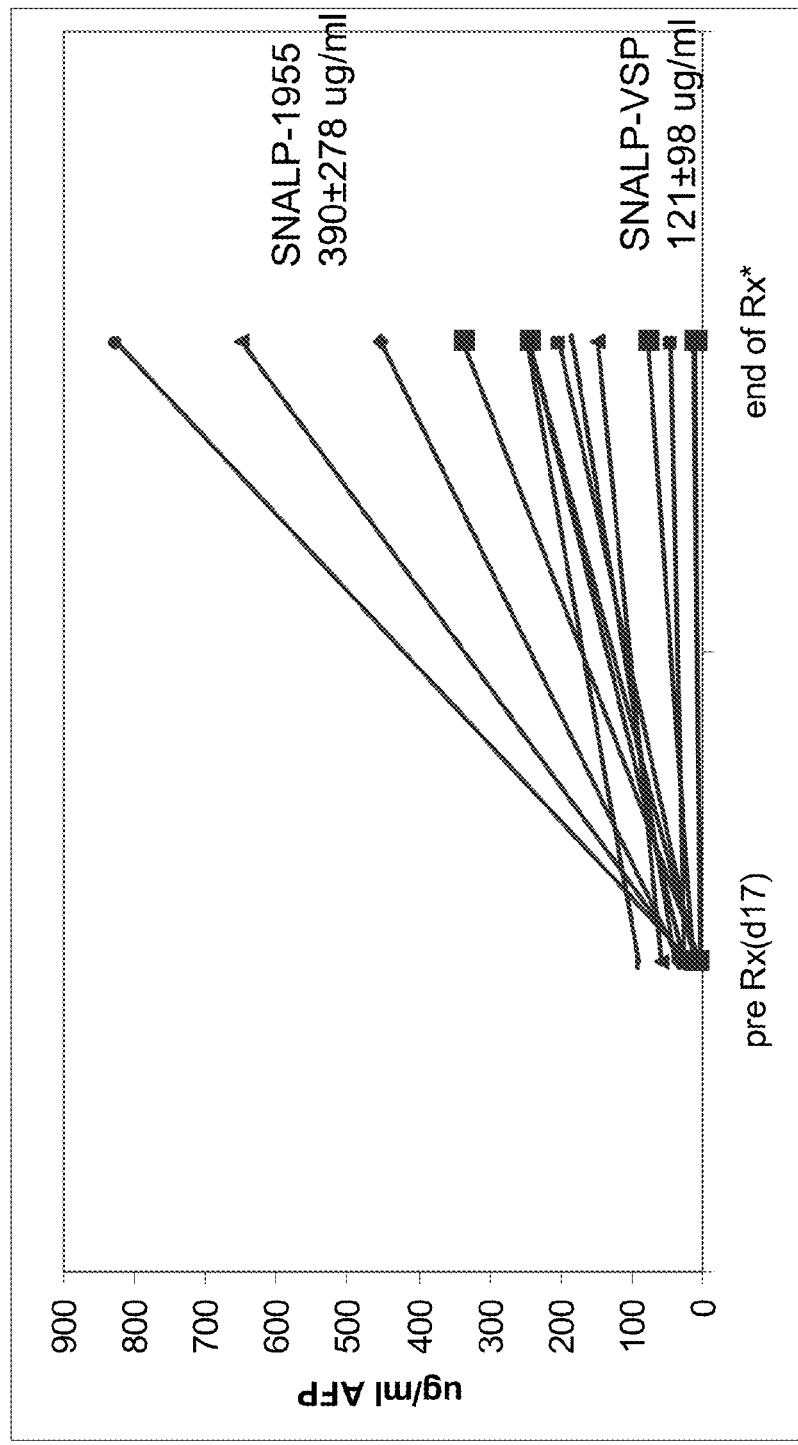
FIG. 14 is a graph showing the effects of SNALP-siRNAs on serum alpha fetoprotein (AFP) levels.

Tumor burden was monitored using serum AFP levels during the course of the experiment. Alpha-fetoprotein (AFP) is a major plasma protein produced by the yolk sac and the liver during fetal life. The protein is thought to be the fetal counterpart of serum albumin, and human AFP and albumin gene are present in tandem in the same transcriptional orientation on chromosome 4. AFP is found in monomeric as well as dimeric and trimeric forms, and binds copper, nickel, fatty acids and bilirubin. AFP levels decrease gradually after birth, reaching adult levels by 8-12 months. Normal adult AFP levels are low, but detectable. AFP has no known function in normal adults and AFP expression in adults is often associated with a subset of tumors such as hepatoma and teratoma. AFP is a tumor marker used to monitor testicular cancer, ovarian cancer, and malignant teratoma. Principle tumors that secrete AFP include endodermal sinus tumor (yolk sac carcinoma), neuroblastoma, hepatoblastoma, and heptocellular carcinoma. In patients with AFP-secreting tumors, serum levels of AFP often correlate with tumor size. Serum levels are useful in assessing response to treatment. Typically, if levels of AFP go down after treatment, the tumor is not growing. A temporary increase in AFP immediately following chemotherapy may indicate not that the tumor is growing but rather that it is shrinking (and releasing AFP as the tumor cells die). Resection is usually associated with a fall in serum levels. As shown in FIG. 14, tumor burden in SNALP-VSP treated animals was significantly reduced.

Figure 13B:
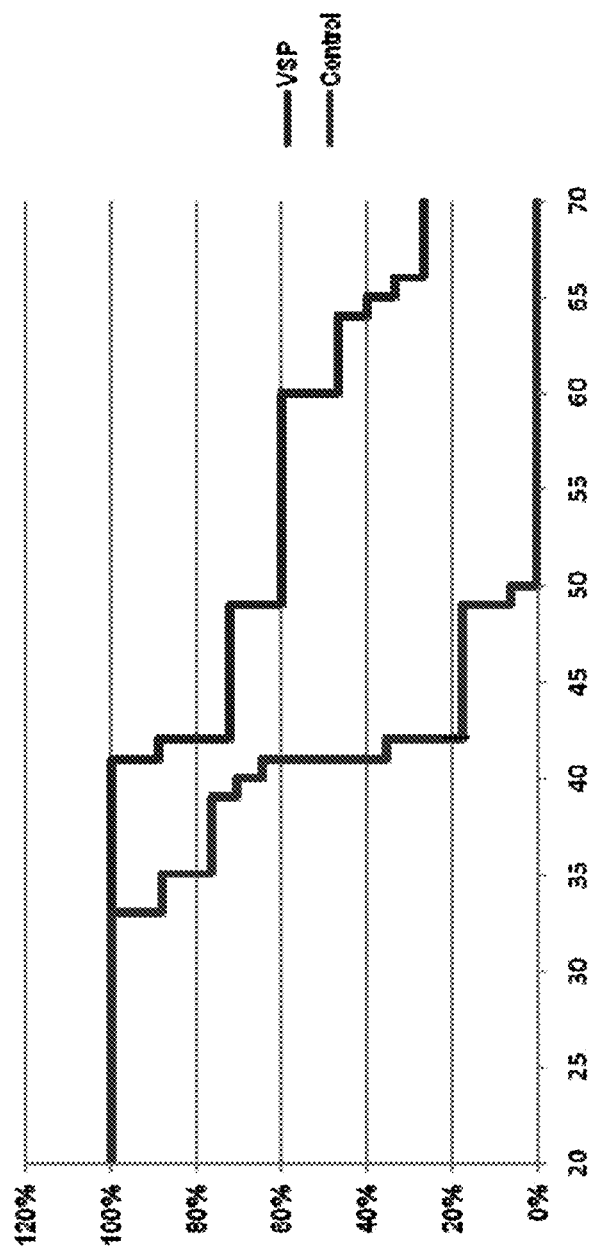

The experiment was repeated with SNALP-siRNA treatment at 26, 29, 32 35, 39, and 42 days after implantation. The data is shown in FIG. 13B. The mean survival of SNALP-VSP animals was extended by approximately 15 days versus SNALP-Luc treated animals by approximately 19 days, or 38%.

Example 8

Induction of Mono-asters in Established Tumors

Figure 15:
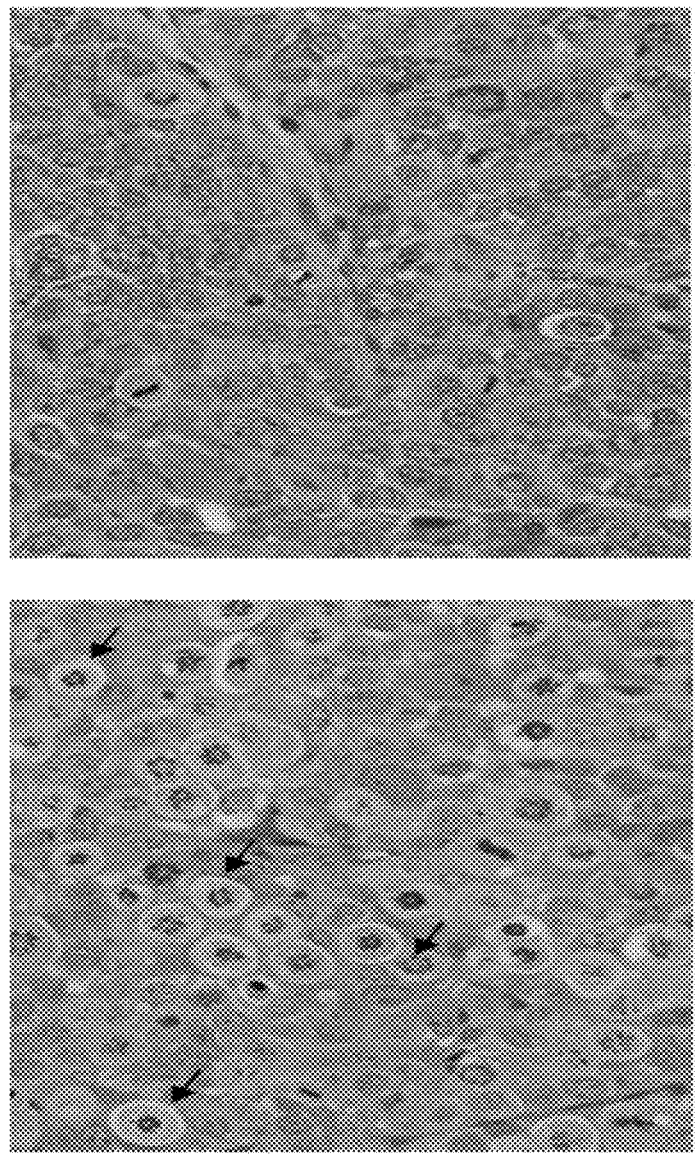
FIGS. 15A and 15B are images of H&E stained sections in tumor bearing animals (three weeks after Hep3B cell implantation) were administered 2 mg/kg SNALP-VSP (A) or 2 mg/kg SNALP-Luc (B). Twenty four hours later, tumor bearing liver lobes were processed for histological analysis. Arrows indicate mono asters.

Inhibition of KSP in dividing cells leads to the formation of mono asters that are readily observable in histological sections. To determine whether mono aster formation occurred in SNALP-VSP treated tumors, tumor bearing animals (three weeks after Hep3B cell implantation) were administered 2 mg/kg SNALP-VSP via tail vein injection. Control animals received 2 mg/kg SNALP-Luc. Twenty four hours later, animals were sacrificed, and tumor bearing liver lobes were processed for histological analysis. Representative images of H&E stained tissue sections are shown in FIG. 15. Extensive mono aster formation was evident in ALN VSP02 treated (A), but not SNALP-Luc treated (B), tumors. In the latter, normal mitotic figures were evident. The generation of mono asters is a characteristic feature of KSP inhibition and provides further evidence that SNALP-VSP has significant activity in established liver tumors.

Example 9

Manufacturing Process and Product Specification of ALN-VSP02 (SNALP-VSP)

ALN-VSP02 product contains 2 mg/mL of drug substance ALN-VSPDS01 formulated in a sterile lipid particle formulation (referred to as SNALP) for IV administration via infusion. Drug substance ALN-VSPDS01 consists of two siRNAs (ALN-12115 targeting KSP and ALN-3133 targeting VEGF) in an equimolar ratio. The drug product is packaged in mL glass vials with a fill volume of 5 mL.

The following terminology is used herein:

| Drug Substance | siRNA Duplexes | Single Strand Intermediates |
|---|---|---|
| ALN-VSPDS01 | ALN-12115* | Sense: A-19562 |
|  |  | Antisense: A-19563 |
|  | ALN-3133** | Sense: A-3981 |
|  |  | Antisense: A-3982 |

*Alternate names = AD-12115, AD12115;
**Alternate names = AD-3133, AD3133

9.1 Preparation of drug substance ALN-VSPDS01

The two siRNA components of drug substance ALN-VSPDS01, ALN-12115 and ALN-3133, are chemically synthesized using commercially available synthesizers and raw materials. The manufacturing process consists of synthesizing the two single strand oligonucleotides of each duplex (A 19562 sense and A 19563 antisense of ALN 12115 and A 3981 sense and A 3982 antisense of ALN 3133) by conventional solid phase oligonucleotide synthesis using phosphoramidite chemistry and 5' O dimethoxytriphenylmethyl (DMT) protecting group with the 2' hydroxyl protected with tert butyldimethylsilyl (TBDMS) or the 2' hydroxyl replaced with a 2' methoxy group (2' OMe). Assembly of an oligonucleotide chain by the phosphoramidite method on a solid support such as controlled pore glass or polystyrene. The cycle consists of 5' deprotection, coupling, oxidation, and capping. Each coupling reaction is carried out by activation of the appropriately protected ribo, 2' OMe, or deoxyribonucleoside amidite using 5 (ethylthio) 1H tetrazole reagent followed by the coupling of the free 5' hydroxyl group of a support immobilized protected nucleoside or oligonucleotide. After the appropriate number of cycles, the final 5' protecting group is removed by acid treatment. The crude oligonucleotide is cleaved from the solid support by aqueous methylamine treatment with concomitant removal of the cyanoethyl protecting group as well as nucleobase protecting groups. The 2' O TBDMS group is then cleaved using a hydrogen fluoride containing reagent to yield the crude oligoribonucleotide, which is purified using strong anion exchange high performance liquid chromatography (HPLC) followed by desalting using ultrafiltration. The purified single strands are analyzed to confirm the correct molecular weight, the molecular sequence, impurity profile and oligonucleotide content, prior to annealing into the duplexes. The annealed duplex intermediates ALN 12115 and ALN 3133 are either lyophilized and stored at 20° C. or mixed in 1:1 molar ratio and the solution is lyophilized to yield drug substance ALN VSPDS01. If the duplex intermediates were stored as dry powder, they are redissolved in water before mixing. The equimolar ratio is achieved by monitoring the mixing process by an HPLC method.

Figure 16:
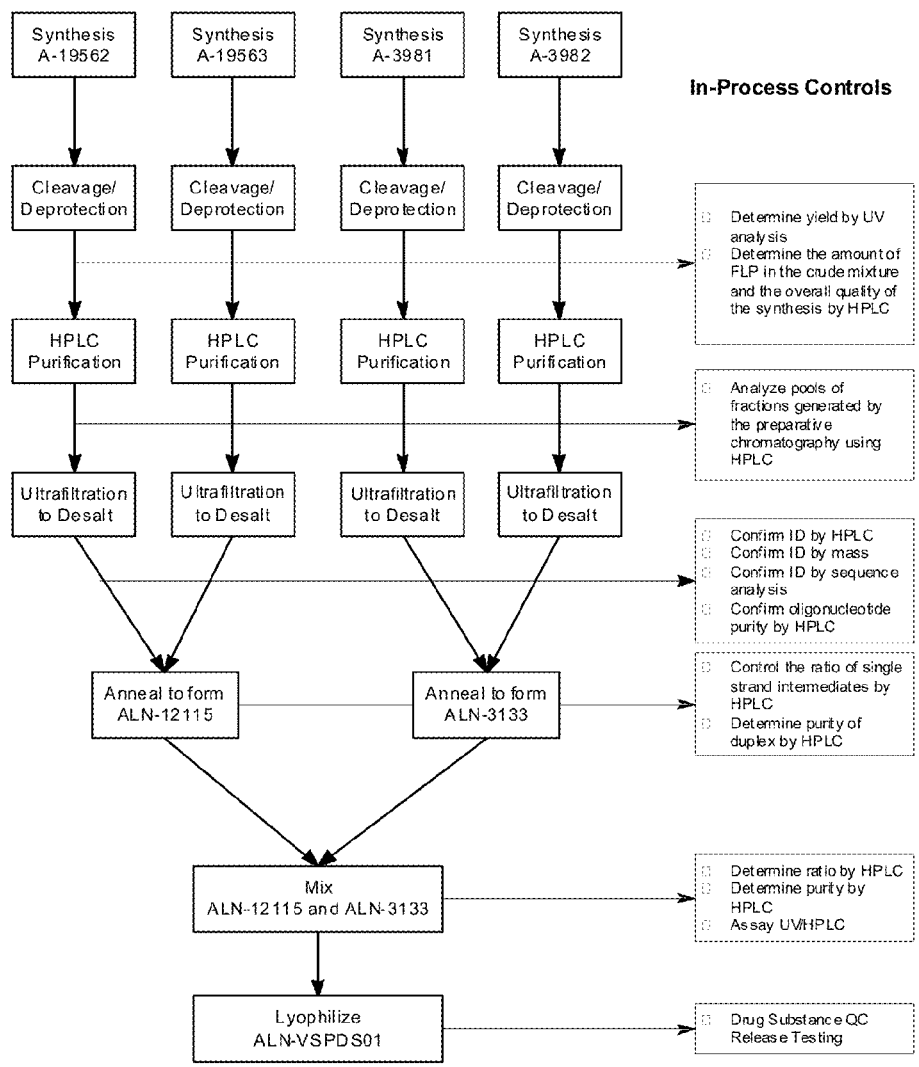
FIG. 16 is a flow diagram illustrating the manufacturing process of ALN-VSPDS01.

The manufacturing process flow diagram is shown in FIG. 16.

Example specifications are shown in Table 16a.

The results of up to 12 month stability testing for ALN-VSPDS01 drug substance are shown in Tables 16c. The assay methods were chosen to assess physical property (appearance, pH, moisture), purity (by SEC and denaturing anion exchange chromatography) and potency (by denaturing anion exchange chromatography [AX-HPLC]).

TABLE 16a

Example specifications for ALN-VSPDS01

| Test | Method | Acceptance Criteria |
|---|---|---|
| Appearance | Visual | White to off-white powder |
| Identity, ALN-VSPDS01 ALN-3133 ALN-12115 | Duplex AX-HPLC | Duplex retention times are consistent with those of reference standards |
| Identity, ALN-VSPDS01 | MS | Molecular weight of single strands are within the following ranges: A-3981: 6869-6873 Da A-3982: 7305-7309 Da A-19562: 6762-6766 Da A-19563: 6675-6679 Da |
| Sodium counter ion (% w/w on anhydrous basis) | Flame AAS or ICP-OES | Report data |
| ALN-VSPDS01 assay | Denaturing AX-HPLC | 90-110% |
| Purity of ALN-VSPDS01 | SEC | ≥90.0 area % |
| Single strand purity, ALN-VSPDS01 | Denaturing AX-HPLC | Report data Report area % for total impurities |
| siRNA molar ratio | Duplex AX-HPLC | 1.0 ± 0.1 |
| Moisture content | Karl Fischer titration | ≤15% |
| Residual solvents Acetonitrile Ethanol Isopropanol | HS-Capillary GC | ≤410 ppm ≤5000 ppm ≤5000 ppm |
| pH of 1% solution | USP <791> | Report data |
| Heavy metals As, Cd, Cu, Cr, Fe, Ni, Pb, Sn | ICP-MS | Report data |
| Bacterial endotoxins | USP <85> | ≤0.5 EU/mg |
| Bioburden | Modified USP <61> | <100 CFU/g |

TABLE 16b

Stability of drug substance

Lot No.: A05M07001N    Study Storage Conditions: −20° C. (Storage Condition)

| Test | Method | Acceptance Criteria | Results Initial | 1 Month | 3 Months | 6 Months | 12 Months |
|---|---|---|---|---|---|---|---|
| Appearance | Visual | White to off-white powder | Pass | Pass | Pass | Pass | Pass |
| pH | USP <791> | Report data | 6.7 | 6.4 | 6.6 | 6.4 | 6.8 |
| Moisture content (% w/w) | Karl Fischer titration | ≤15% | 3.6* | 6.7 | 6.2 | 5.6 | 5.0 |
| Purity (area %) | SEC | ≥90.0 area % | 95 | 95 | 94 | 92 | 95 |
| A-3981 (sense) (area %) | Denaturing AX-HPLC | Report data | 24 | 23 | 23 | 23 | 23 |
| A-3982 (antisense) (area %) | Denaturing AX-HPLC | Report data | 23 | 23 | 23 | 23 | 24 |
| A-19562 (sense) (area %) | Denaturing AX-HPLC | Report data | 22 | 21 | 21 | 21 | 21 |
| A-19563 (antisense) (area %) | Denaturing AX-HPLC | Report data | 23 | 22 | 22 | 22 | 22 |

9.2 Preparation of drug product ALN-VSP02 (SNALP-VSP)

Figure 17:
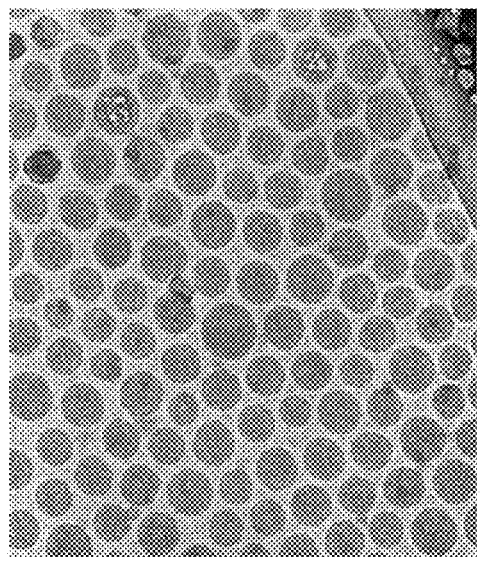
FIG. 17 is a cryo-transmission electron microscope (cryo-TEM) image of ALN-VSP02.

ALN VSP02, is a sterile formulation of the two siRNAs (in a 1:1 molar ratio) with lipid excipients in isotonic buffer. The lipid excipients associate with the two siRNAs, protect them from degradation in the circulatory system, and aid in their delivery to the target tissue. The specific lipid excipients and the quantitative proportion of each (shown in Table 17) have been selected through an iterative series of experiments comparing the physicochemical properties, stability, pharmacodynamics, pharmacokinetics, toxicity and product manufacturability of numerous different formulations. The excipient DLinDMA is a titratable aminolipid that is positively charged at low pH, such as that found in the endosome of mammalian cells, but relatively uncharged at the more neutral pH of whole blood. This feature facilitates the efficient encapsulation of the negatively charged siRNAs at low pH, preventing formation of empty particles, yet allows for adjustment (reduction) of the particle charge by replacing the formulation buffer with a more neutral storage buffer prior to use. Cholesterol and the neutral lipid DPPC are incorporated in order to provide physicochemical stability to the particles. The polyethyleneglycol lipid conjugate PEG2000 C DMA aids drug product stability, and provides optimum circulation time for the proposed use. ALN VSP02 lipid particles have a mean diameter of approximately 80-90 nm with low polydispersity values. A representative cryo transmission electron microscope (cryo TEM) image is shown in FIG. 17. At neutral pH, the particles are essentially uncharged, with Zeta Potential values of less than 6 mV. There is no evidence of empty (non loaded) particles based on the manufacturing process.

TABLE 17

Quantitative Composition of ALN-VSP02

| Component, grade | Proportion (mg/mL) |
|---|---|
| ALN-VSPDS01, cGMP | 2.0* |
| DLinDMA (1,2-Dilinoleyloxy-N,N-dimethyl-3-aminopropane), cGMP | 7.3 |
| DPPC (R-1,2-Dipalmitoyl-sn-glycero-3-phosphocholine), cGMP | 1.1 |
| Cholesterol, Synthetic, cGMP | 2.8 |
| PEG2000-C-DMA (3-N-[(ω-Methoxy poly(ethylene glycol) 2000) carbamoyl]-1,2-dimyristyloxy-propylamine), cGMP | 0.8 |
| Phosphate Buffered Saline, cGMP | q.s. |

*The 1:1 molar ratio of the two siRNAs in the drug product is maintained throughout the size distribution of the drug product particles.

Figure 18:
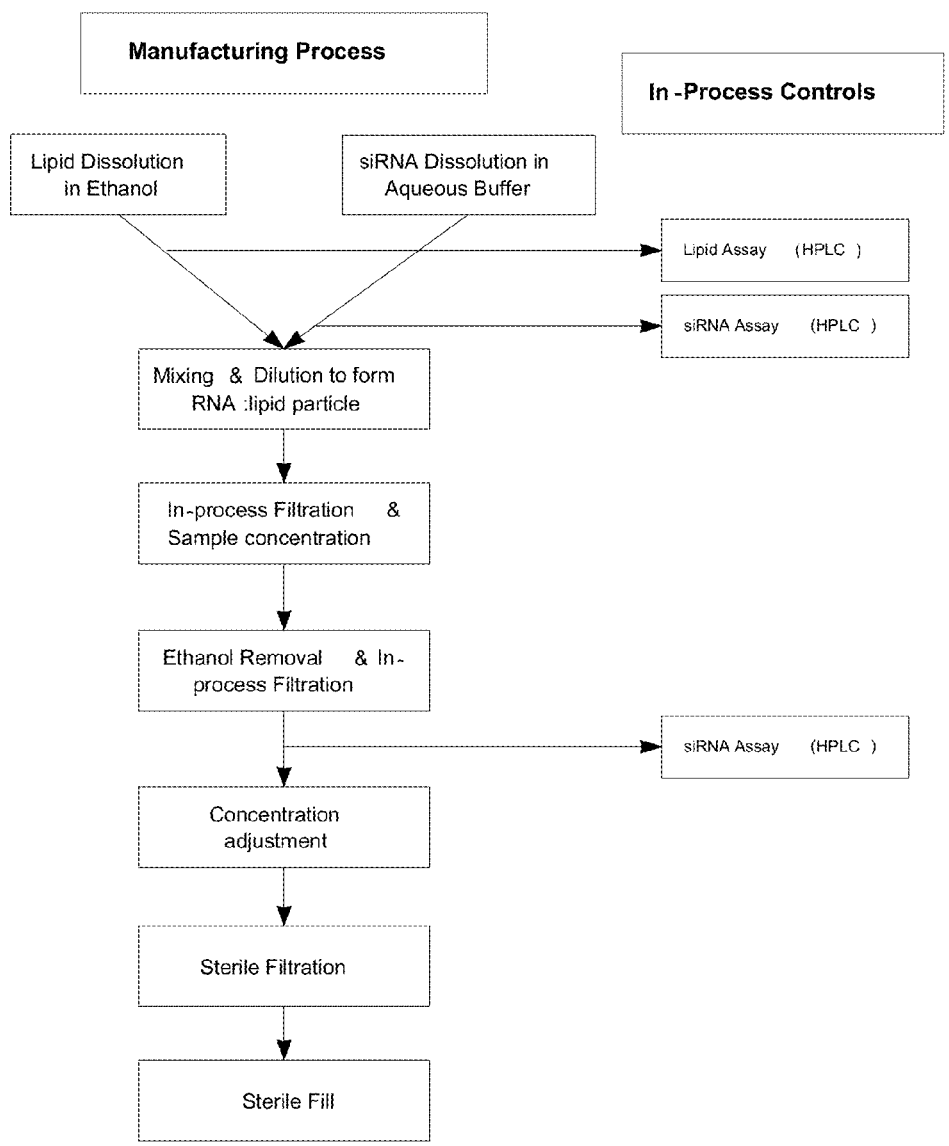
FIG. 18 is a flow diagram illustrating the manufacturing process of ALN-VSP02.

Solutions of lipid (in ethanol) and ALN VSPDS01 drug substance (in aqueous buffer) are mixed and diluted to form a colloidal dispersion of siRNA lipid particles with an average particle size of approximately 80-90 nm. This dispersion is then filtered through 0.45/0.2 μm filters, concentrated, and diafiltered by Tangential Flow Filtration. After in process testing and concentration adjustment to 2.0 mg/mL, the product is sterile filtered, aseptically filled into glass vials, stoppered, capped and placed at 5±3° C. The ethanol and all aqueous buffer components are USP grade; all water used is USP Sterile Water For Injection grade. Representative ALN-VSP02 process is shown in flow diagram in FIG. 18.

TABLE 18a

Example ALN-VSP02 specifications

| Test | Analytical Procedure | Acceptance Criteria |
|---|---|---|
| Appearance | Visual | White to off-white, homogeneous opalescent liquid, no foreign particles |
| pH | USP <791> | 6.8-7.8 |
| Osmolality | USP <785> | 250-350 mOsm/kg |
| Identity, ALN-VSPDS01 ALN-3133 ALN-12115 | Duplex Anion Exchange (AX)-HPLC | Retention times consistent with those of reference standards |
| Identity, ALN-VSPDS01 A-3981 A-3982 A-19562 A-19563 | Denaturing AX-HPLC | Retention times consistent with those of reference standards |
| Lipid identity DLinDMA PEG$_{2000}$-C-DMA DPPC Cholesterol | Reversed Phase (RP)-HPLC with Evaporative Light Scattering (ELS) detection | Retention times consistent with those of reference standards |
| ALN-VSPDS01 label claim (Strength/Potency) | Denaturing AX-HPLC | 1.7-2.3 mg/mL |
| Duplex molar ratio | Duplex AX-HPLC | 1.0 ± 0.1 |
| DLinDMA content | RP-HPLC with ELS detection | 5.6-10.3 mg/mL |
| PEG$_{2000}$-C-DMA content | RP-HPLC with ELS detection | 0.6-1.1 mg/mL |
| DPPC content | RP-HPLC with ELS detection | 0.8-1.5 mg/mL |
| Cholesterol content | RP-HPLC with ELS detection | 2.1-3.9 mg/mL |
| Total lipid:ALN-VSPDS01 ratio | Calculated from total lipid assay and label claim for drug substance | 4.9-8.1 mg/mg |
| ALN-VSPDS01 encapsulation | Fluorometric assay | ≥90.0% |
| Purity | Denaturing AX-HPLC | ≥80.0 area % |
| Impurity profile | Denaturing AX-HPLC | Report retention times (relative to A-19563) and area % for all peaks ≥0.20% |
| Residual ethanol | USP <467> | ≤5000 ppm |
| Residual EDTA | Ion Pairing (IP)-HPLC with UV detection | ≤2000 μg/mL |
| Particle size Z average | Dynamic light scattering | 60-120 nm |
| Polydispersity | Dynamic light scattering | ≤0.15 |

TABLE 18a-continued

Example ALN-VSP02 specifications

| Test | Analytical Procedure | Acceptance Criteria |
|---|---|---|
| Particle size distribution | Dynamic light scattering | Report data |
| $D_{10}$ | | |
| $D_{50}$ | | |
| $D_{90}$ | | |
| Particulate matter | Modified USP <788> | |
| ≥25 μm | | ≤300 per container |
| ≥10 μm | | ≤3000 per container |
| Bacterial endotoxins | Modified USP <85> | ≤5.0 EU/mL |
| Sterility | USP <71> | Pass |
| Volume in container | USP <1> | ≥5.0 mL |
| Dose uniformity | USP <905> | Pass |
| Heavy metal analysis | Inductive Coupled Plasma Mass Spectrometry (ICP-MS) | Report data |

9.4 Container/Closure System

The ALN VSP02 drug product is packaged in 10 mL glass vials with a fill volume of 5 mL. The container closure system is comprised of a USP/EP Type I borosilicate glass vial, a teflon faced butyl rubber stopper and an aluminum flip off cap. The drug product will be stored at 5±3° C.

9.5 Stability of Drug Product ALN-VSP02

Stability data (25° C./60% RH) are given in Table 18b and 18c.

TABLE 18b

Example ALN-VSPO2 stability at storage conditions

| | Lot No.: IC097 | | Study Storage Conditions: 2-8° C. Results | | | | | |
|---|---|---|---|---|---|---|---|---|
| Test | Method | Acceptance Criteria | Initial | 1 Month | 2 Months | 3 Months | 4 Months | 6 Months |
| Appearance | Visual | White to off-white, homogeneous opalescent liquid, no foreign particles | Pass | Pass | Pass | Pass | Pass | Pass |
| pH | USP <791> | 6.8-7.8 | 7.4 | 7.4 | 7.4 | 7.3 | 7.4 | 7.3 |
| Osmolality | USP <791> | 250-350 mOsm/kg | 308 | 307 | 305 | 306 | 309 | 305 |
| ALN-VSPDS01 Identity, ALN-3133 ALN-12115 | Duplex AX-HPLC | Retention times consistent with those of reference standards | Pass | Pass | Pass | Pass | Pass | Pass |
| ALN-VSPDS01 Identity, A-3981 A-3982 A-19562 A-19563 | Denaturing AX-HPLC | Retention times consistent with those of reference standards | Pass | Pass | Pass | Pass | Pass | Pass |
| Lipid identity, DLinDMA PEGr000-C-DMA DPPC Cholesterol | RP-HPLC with ELS Detection | Retention times consistent with those of reference standards | Pass | Pass | Pass | Pass | Pass | Pass |
| ALN-VSPDS01 strength/potency | Denaturing AX-HPLC | 1.7-2.3 mg/mL | 2.1 | 2.2 | 2.1 | 2.1 | 2.1 | 2.1 |
| Duplex molar ratio | Duplex AX-HPLC | 1.0 ± 0.1 | 1.0 | 1.0 | 1.0 | 1.0 | 1.0 | 1.0 |
| DLinDMA content | RP-HPLC with ELS Detection | 5.6-10.3 mg/mL | 9.1 | 9.4 | 9.1 | 9.6 | 9.1 | 9.2 |
| Cholesterol content | RP-HPLC with ELS Detection | 2.1-3.9 mg/mL | 3.4 | 3.5 | 3.4 | 3.5 | 3.4 | 3.5 |

TABLE 18b-continued

Example ALN-VSPO2 stability at storage conditions

Lot No.: IC097 — Study Storage Conditions: 2-8° C. Results

| Test | Method | Acceptance Criteria | Initial | 1 Month | 2 Months | 3 Months | 4 Months | 6 Months |
|---|---|---|---|---|---|---|---|---|
| DPPC content | RP-HPLC with ELS Detection | 0.8-1.5 mg/mL | 1.3 | 1.3 | 1.4 | 1.4 | 1.2 | 1.3 |
| $PEG_{2000}$-C-DMA content | RP-HPLC with ELS Detection | 0.6-1.1 mg/mL | 1.0 | 1.0 | 1.0 | 1.1 | 1.0 | 1.0 |
| Total lipid: ALN-VSPDS01 ratio | Calculation | 4.9-8.1 mg/mg | 7.0 | 6.9 | 7.1 | 7.4 | 7.0 | 7.1 |
| ALN-VSPDS01 encapsulation | Fluorometric assay | ≥90.0% | 95.9 | 96.5 | 94.4 | 98.1 | 97.8 | 96.4 |
| Purity | Denaturing AX-HPLC | ≥80.0% | 90.7 | 89.6 | 90.8 | 91.3 | 92.4 | 90.8 |
| Particle size, Z-average | Light scattering | 60-120 nm | 86 | 87 | 87 | 87 | 87 | 87 |
| Polydispersity | Light scattering | ≤0.15 | 0.02 | 0.03 | 0.02 | 0.03 | 0.03 | 0.03 |
| Particle size distribution, $D_{10}$ | Light scattering | Report data (nm) | 56 | 56 | 56 | 56 | 56 | 56 |
| Particle size distribution, $D_{50}$ | Light scattering | Report data (nm) | 76 | 77 | 77 | 77 | 78 | 77 |
| Particle size distribution, $D_{90}$ | Light scattering | Report data (nm) | 110 | 112 | 112 | 113 | 112 | 113 |
| Particulate matter, ≥25 μm ≥10 μm | Modified USP <788> | (per container) ≤300 ≤3000 | 18 48 | NS | NS | NS | NS | 3 11 |
| Bacterial endotoxins | USP <85> | ≤5.0 EU/mL | 0.50 | NS | NS | NS | NS | NS |
| Sterility | USP <71> | Pass | Pass | NS | NS | NS | NS | NS |

TABLE 18c

Example ALN-VSPO2 stability at 25° C./ambient humidity

Lot No.: IC097 — Study Storage Conditions: 25° C./ambient humidity Results

| Test | Method | Acceptance Criteria | Initial | 1 Month | 2 Months | 3 Months | 4 Months | 6 Months |
|---|---|---|---|---|---|---|---|---|
| Appearance | Visual | White to off-white, homogeneous opalescent liquid, no foreign particles | Pass | Pass | Pass | Pass | Pass | Pass |
| pH | USP <791> | 6.8-7.8 | 7.4 | 7.3 | 7.2 | 7.1 | 7.2 | 7.1 |
| Osmolality | USP <785> | 250-350 mOsm/kg | 308 | 306 | 304 | 307 | 307 | 304 |
| ALN-VSPDS01 Identity, ALN-3133 ALN-12115 | Duplex AX-HPLC | Retention times consistent with those of reference standards | Pass | Pass | Pass | Pass | Pass | Pass |

TABLE 18c-continued

Example ALN-VSPO2 stability at 25° C./ambient humidity

| | Lot No.: IC097 | | Study Storage Conditions: 25° C./ambient humidity Results | | | | | |
|---|---|---|---|---|---|---|---|---|
| Test | Method | Acceptance Criteria | Initial | 1 Month | 2 Months | 3 Months | 4 Months | 6 Months |
| ALN-VSPDS01 Identity, A-3981 A-3982 A-19562 A-19563 | Denaturing AX-HPLC | Retention times consistent with those of reference standards | Pass | Pass | Pass | Pass | Pass | Pass |
| Lipid identity, DLinDMA $PEG_{2000}$-C-DMA DPPC Cholesterol | RP-HPLC with ELS Detection | Retention times consistent with those of reference standards | Pass | Pass | Pass | Pass | Pass | Pass |
| ALN-VSPDS01 strength/potency | Denaturing AX-HPLC | 1.7-2.3 mg/mL | 2.1 | 2.1 | 2.0 | 2.0 | 2.0 | 2.0 |
| Duplex molar ratio | Duplex AX-HPLC | 1.0 ± 0.1 | 1.0 | 1.0 | 1.0 | 1.0 | 1.0 | 1.0 |
| DLinDMA content | RP-HPLC with ELS Detection | 5.6-10.3 mg/mL | 9.1 | 9.6 | 9.0 | 9.3 | 9.2 | 9.3 |
| Cholesterol content | RP-HPLC with ELS Detection | 2.1-3.9 mg/mL | 3.4 | 3.5 | 3.4 | 3.5 | 3.4 | 3.5 |
| DPPC content | RP-HPLC with ELS Detection | 0.8-1.5 mg/mL | 1.3 | 1.3 | 1.3 | 1.2 | 1.2 | 1.1 |
| $PEG_{2000}$-C-DMA content | RP-HPLC with ELS Detection | 0.6-1.1 mg/mL | 1.0 | 1.0 | 1.0 | 1.1 | 1.0 | 1.0 |
| Total lipid: ALN-VSPDS01 ratio | Calculation | 4.9-8.1 mg/mg | 7.0 | 7.3 | 7.4 | 7.6 | 7.4 | 7.5 |
| ALN-VSPDS01 encapsulation | Fluorometric assay | ≥90.0% | 95.9 | 97.2 | 94.6 | 97.9 | 97.9 | 96.7 |
| Purity | Denaturing AX-HPLC | ≥80.0% | 90.7 | 88.0 | 88.9 | 88.4 | 89.0 | 85.3 |
| Particle size, Z-average | Light scattering | 60-120 nm | 86 | 85 | 86 | 89 | 87 | 87 |
| Polydispersity | Light scattering | ≤0.15 | 0.02 | 0.05 | 0.03 | 0.04 | 0.04 | 0.03 |
| Particle size distribution, $D_{10}$ | Light scattering | Report data (nm) | 56 | 54 | 56 | 58 | 56 | 57 |
| Particle size distribution, $D_{50}$ | Light scattering | Report data (nm) | 76 | 75 | 77 | 79 | 77 | 78 |
| Particle size distribution, $D_{90}$ | Light scattering | Report data (nm) | 110 | 110 | 111 | 116 | 113 | 113 |
| Particulate matter, ≥25 μm ≥10 μm | Modified USP <788> | (per container) ≤300 ≤3000 | 18 48 | NS | NS | NS | NS | 1 16 |
| Bacterial endotoxins | USP <85> | ≤5.0 EU/mL | 0.50 | NS | NS | NS | NS | <0.50 |
| Sterility | USP <71> | Pass | Pass | NS | NS | NS | NS | Pass |

Example 10

In Vitro Efficacy of ALN-VSP02 in Human Cancer Cell Lines

The efficacy of ALN-VSP02 treatment in human cancer cell lines was determined via measurement of KSP mRNA, VEGF mRNA, and cell viability after treatment. IC50 (nM) values determined for KSP and VEGF in each cell line.

TABLE 19

| cell lines | |
|---|---|
| Cell line tested | ATCC cat number |
| HELA | ATCC Cat N: CCL-2 |
| KB | ATCC Cat N: CCL-17 |
| HEP3B | ATCC Cat N: HB-8064 |
| SKOV-3 | ATCC Cat N: HTB-77 |
| HCT-116 | ATCC Cat N: CCL-247 |
| HT-29 | ATCC Cat N: HTB-38 |
| PC-3 | ATCC Cat N: CRL-1435 |
| A549 | ATCC Cat N: CCL-185 |
| MDA-MB-231 | ATCC Cat N: HTB-26 |

Cells were plated in 96 well plates in complete media at day 1 to reach a density of 70% on day 2. On day 2 media was replaced with Opti-MEM reduced serum media (Invitrogen Cat N: 11058-021) and cells were transfected with either ALN-VSP02 or control SNALP-Luc with concentration range starting at 1.8 μM down to 10 μM. After 6 hours the media was changed to complete media. Three replicate plates for each cell line for each experiment was done.

Cells were harvested 24 hours after transfection. KSP levels were measured using bDNA; VEGF mRNA levels were measured using human TaqMan assay.

Viability was measured using Cell Titer Blue reagent (Promega Cat N: G8080) at 48 and/or 72 h following manufacturer's recommendations.

As shown in Table 20, nM concentrations of VSP02 are effective in reducing expression of both KSP and VEGF in multiple human cell lines. Viability of treated cells was not

TABLE 20

| Results | | |
|---|---|---|
| Cell line | IC50 (nM) KSP | IC50 (nM) VEGF |
| HeLa | 8.79 | 672 |
| SKOV-3 | 142 | 1347 |
| HCT116 | 31.6 | 27.5 |
| Hep3B | 1.3 | 14.5 |
| HT-29 | 262 | ND |
| PC3 | 127 | ND |
| KB | 50.6 | ND |
| A549 | 201 | ND |
| MB231 | 187 | ND |

Example 11

Anti-Tumor Efficacy of VSP SNALP Vs. Sorafenib in Established Hep3B Intrahepatic Tumors The anti-tumor effects of multi-dosing VSP SNALP verses Sorafenib in scid/beige mice bearing established Hep3B intrahepatic tumors was studied. Sorafenib is a small molecule inhibitor of protein kinases approved for treatment of hepatic cellular carcinoma (HCC).

Tumors were established by intrahepatic seeding in scid/beige mice as described herein. Treatment was initiated 11 days post-seeding. Mice were treated with Sorafenib and a control siRNA-SNALP, Sorafenib and VSP siRNA-SNALP, or VSP siRNA-SNALP only. Control mice were treated with buffers only (DMSO for Sorafenib and PBS for siRNA-SNALP). Sorafenib was administered intraparenterally from Mon to Fri for three weeks, at mg/kg according to body weight for a total of 15 injections. Sorafenib was administered a minimum of 1 hour after SNALP injections. The siRNA-SNALPS were administered intravenously via the lateral tail vein according at 3 mg/kg based on the most recently recorded body weight (10 ml/kg) for 3 weeks (total of 6 doses) on days 1, 4, 7, 10, 14, and 17.

Mice were euthanized based on an assessment of tumor burden including progressive weight loss and clinical signs including condition, abdominal distension/discoloration and mobility.

Figure 19:
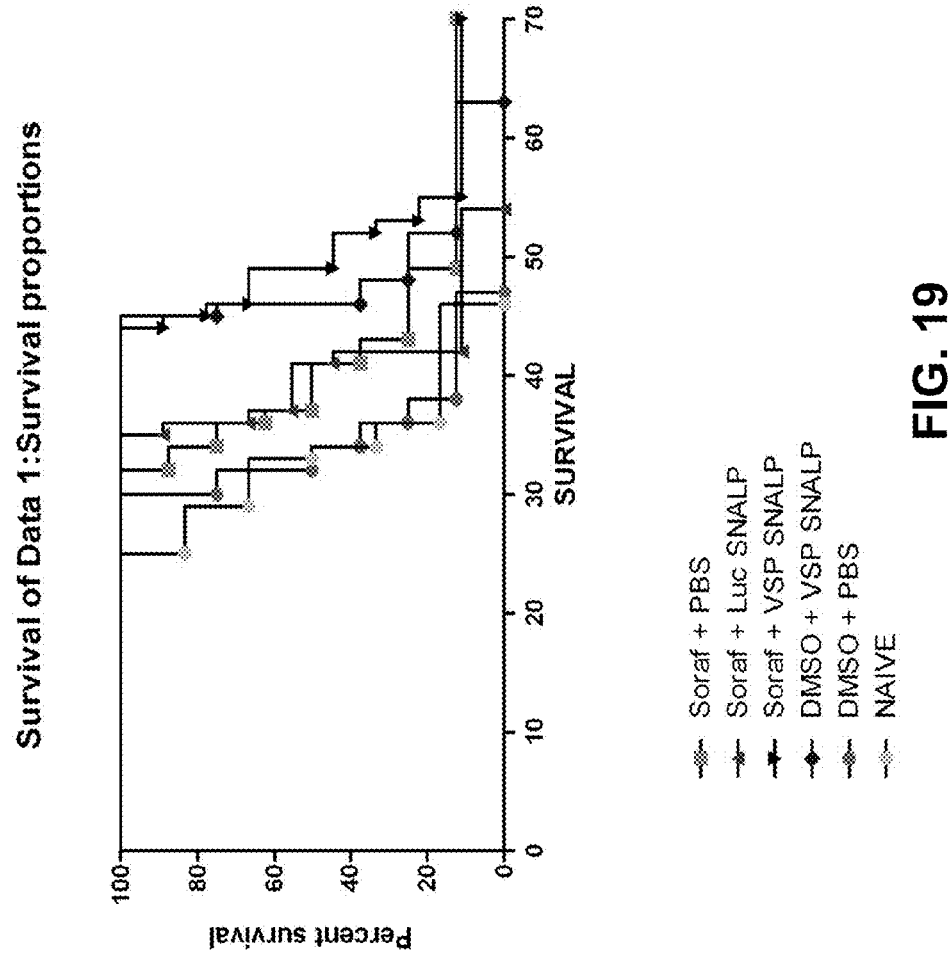
FIG. 19 is a graph illustrating the effects on survival of administration SNALP formulated siRNA and Sorafenib.

The percent survival data are shown in FIG. 19. Co-administration of VSP siRNA-SNALP with Sorafenib increased survival proportion compared to administration of Sorafenib or VSP siRNA-SNALP alone. VSP siRNA-SNALP increased survival proportion compared to Sorafenib.

Example 12

In Vitro Efficacy of VSP Using Variants of AD-12115 and AD-3133

Two sets of duplexes targeted to Eg5/KSP and VEGF were designed and synthesized. Each set included duplexes tiling 10 nucleotides in each direction of the target sites for either AD-12115 and AD-3133.

Sequences of the target, sense strand, and antisense strand for each duplex are shown in the Table below.

Each duplex is assayed for inhibition of expression using the assays described herein.

The duplexes are administered alone and/or in combination, e.g., an Eg5/KSP dsRNA in combination with a VEGF dsRNA. In some embodiments, the dsRNA are administered in a SNALP formulation as described herein.

TABLE 21

Sequences of dsRNA targeted to VEGF and Eg5/KSP (tiling)

| Duplex ID | target gene | target sequence 5' to 3' | SEQ ID NO: | Sense Strand Antisense strand 5' to 3' | SEQ ID NO: |
|---|---|---|---|---|---|
| AD-20447.1 | VEGFA | ACCAAGGCCAGCACAUAGG | 2264 | AccAAGGccAGcAcAuAGGTsT | 2304 |
| | | | | CCuAUGUGCUGGCCUUGGUTsT | 2305 |

TABLE 21-continued

Sequences of dsRNA targeted to VEGF and Eg5/KSP (tiling)

| Duplex ID | target gene | target sequence 5' to 3' | SEQ ID NO: | Sense Strand Antisense strand 5' to 3' | SEQ ID NO: |
|---|---|---|---|---|---|
| AD-20448.1 | VEGFA | CCAAGGCCAGCACAUAGGA | 2265 | ccAAGGccAGcAcAuAGGATsT<br>UCCuAUGUGCUGGCCUUGGTsT | 2306<br>2307 |
| AD-20449.1 | VEGFA | CCAAGGCCAGCACAUAGGA | 2266 | ccAAGGccAGcAcAuAGGATsT<br>CUCCuAUGUGCUGGCCUUGTsT | 2308<br>2309 |
| AD-20450.1 | VEGFA | AAGGCCAGCACAUAGGAGA | 2267 | AAGGccAGcAcAuAGGAGATsT<br>UCUCCuAUGUGCUGGCCUUTsT | 2310<br>2311 |
| AD-20451.1 | VEGFA | AGGCCAGCACAUAGGAGAG | 2268 | AGGccAGcAcAuAGGAGAGTsT<br>CUCUCCuAUGUGCUGGCCUTsT | 2312<br>2313 |
| AD-20452.1 | VEGFA | GGCCAGCACAUAGGAGAGA | 2269 | GGccAGcAcAuAGGAGAGATsT<br>UCUCUCCuAUGUGCUGGCCTsT | 2314<br>2315 |
| AD-20453.1 | VEGFA | GCCAGCACAUAGGAGAGAU | 2270 | GccAGcAcAuAGGAGAGAuTsT<br>AUCUCUCCuAUGUGCUGGCTsT | 2316<br>2317 |
| AD-20454.1 | VEGFA | CCAGCACAUAGGAGAGAUG | 2271 | ccAGcAcAuAGGAGAGAuGTsT<br>cAUCUCUCCuAUGUGCUGGTsT | 2318<br>2319 |
| AD-20455.1 | VEGFA | CAGCACAUAGGAGAGAUGA | 2272 | cAGcAcAuAGGAGAGAuGATsT<br>UcAUCUCUCCuAUGUGCUGTsT | 2320<br>2321 |
| AD-20456.1 | VEGFA | AGCACAUAGGAGAGAUGAG | 2273 | AGcAcAuAGGAGAGAuGAGTsT<br>CUcAUCUCUCCuAUGUGCUTsT | 2322<br>2323 |
| AD-20457.1 | VEGFA | CACAUAGGAGAGAUGAGCU | 2274 | cAcAuAGGAGAGAuGAGcuTsT<br>AGCUcAUCUCUCCuAUGUGTsT | 2324<br>2325 |
| AD-20458.1 | VEGFA | ACAUAGGAGAGAUGAGCUU | 2275 | AcAuAGGAGAGAuGAGcuuTsT<br>AAGCUcAUCUCUCCuAUGUTsT | 2326<br>2327 |
| AD-20459.1 | VEGFA | CAUAGGAGAGAUGAGCUUC | 2276 | cAuAGGAGAGAuGAGcuucTsT<br>GAAGCUcAUCUCUCCuAUGTsT | 2328<br>2329 |
| AD-20460.1 | VEGFA | AUAGGAGAGAUGAGCUUCC | 2277 | AuAGGAGAGAuGAGcuuccTsT<br>GGAAGCUcAUCUCUCCuAUTsT | 2330<br>2331 |
| AD-20461.1 | VEGFA | UAGGAGAGAUGAGCUUCCU | 2278 | uAGGAGAGAuGAGcuuccuTsT<br>AGGAAGCUcAUCUCUCCuATsT | 2332<br>2333 |
| AD-20462.1 | VEGFA | AGGAGAGAUGAGCUUCCUA | 2279 | AGGAGAGAuGAGcuuccuATsT<br>uAGGAAGCUcAUCUCUCCUTsT | 2334<br>2335 |
| AD-20463.1 | VEGFA | GGAGAGAUGAGCUUCCUAC | 2280 | GGAGAGAuGAGcuuccuAcTsT<br>GuAGGAAGCUcAUCUCUCCTsT | 2336<br>2337 |
| AD-20464.1 | VEGFA | GAGAGAUGAGCUUCCUACA | 2281 | GAGAGAuGAGcuuccuAcATsT<br>UGuAGGAAGCUcAUCUCUCTsT | 2338<br>2339 |
| AD-20465.1 | VEGFA | AGAGAUGAGCUUCCUACAG | 2282 | AGAGAuGAGcuuccuAcAGTsT<br>CUGuAGGAAGCUcAUCUCUTsT | 2340<br>2341 |
| AD-20466.1 | VEGFA | GAGAUGAGCUUCCUACAGC | 2283 | GAGAuGAGcuuccuAcAGcTsT<br>GCUGuAGGAAGCUcAUCUCTsT | 2342<br>2343 |
| AD-20467.1 | KSP | AUGUUCCUUAUCGAGAAUC | 2284 | AuGuuccuuAucGAGAAucTsT<br>GAUUCUCGAuAAGGAAcAUTsT | 2344<br>2345 |
| AD-20468.1 | KSP | UGUUCCUUAUCGAGAAUCU | 2285 | uGuuccuuAucGAGAAucuTsT<br>AGAUUCUCGAuAAGGAAcATsT | 2346<br>2347 |
| AD-20469.1 | KSP | GUUCCUUAUCGAGAAUCUA | 2286 | GuuccuuAucGAGAAucuATsT<br>uAGAUUCUCGAuAAGGAACTsT | 2348<br>2349 |
| AD-20470.1 | KSP | UUCCUUAUCGAGAAUCUAA | 2287 | uuccuuAucGAGAAucuAATsT<br>UuAGAUUCUCGAuAAGGAATsT | 2350<br>2351 |
| AD-20471.1 | KSP | UCCUUAUCGAGAAUCUAAA | 2288 | uccuuAucGAGAAucuAAATsT<br>UUuAGAUUCUCGAuAAGGATsT | 2352<br>2353 |

TABLE 21-continued

Sequences of dsRNA targeted to VEGF and Eg5/KSP (tiling)

| Duplex ID | target gene | target sequence 5' to 3' | SEQ ID NO: | Sense Strand Antisense strand 5' to 3' | SEQ ID NO: |
|---|---|---|---|---|---|
| AD-20472.1 | KSP | CCUUAUCGAGAAUCUAAAC | 2289 | ccuuAucGAGAAucuAAAcTsT GUUuAGAUUCUCGAuAAGGTsT | 2354 2355 |
| AD-20473.1 | KSP | CUUAUCGAGAAUCUAAACU | 2290 | cuuAucGAGAAucuAAAcuTsT AGUUuAGAUUCUCGAuAAGTsT | 2356 2357 |
| AD-20474.1 | KSP | UUAUCGAGAAUCUAAACUA | 2291 | uuAucGAGAAucuAAAcuATsT uAGUUuAGAUUCUCGAuAATsT | 2358 2359 |
| AD-20475.1 | KSP | UAUCGAGAAUCUAAACUAA | 2292 | uAucGAGAAucuAAAcuAATsT UuAGUUuAGAUUCUCGAuATsT | 2360 2361 |
| AD-20476.1 | KSP | AUCGAGAAUCUAAACUAAC | 2293 | AucGAGAAucuAAAcuAAcTsT GUuAGUUuAGAUUCUCGAUTsT | 2362 2363 |
| AD-20477.1 | KSP | CGAGAAUCUAAACUAACUA | 2294 | cGAGAAucuAAAcuAAcuATsT uAGUuAGUUuAGAUUCUCGTsT | 2364 2365 |
| AD-20478.1 | KSP | GAGAAUCUAAACUAACUAG | 2295 | GAGAAucuAAAcuAAcuAGTsT CuAGUuAGUUuAGAUUCUCTsT | 2366 2367 |
| AD-20479.1 | KSP | AGAAUCUAAACUAACUAGA | 2296 | AGAAucuAAAcuAAcuAGATsT UCuAGUuAGUUuAGAUUCUTsT | 2368 2369 |
| AD-20480.1 | KSP | GAAUCUAAACUAACUAGAA | 2297 | GAAucuAAAcuAAcuAGAATsT UUCuAGUuAGUUuAGAUUCTsT | 2370 2371 |
| AD-20481.1 | KSP | AAUCUAAACUAACUAGAAU | 2298 | AAucuAAAcuAAcuAGAAuTsT AUUCuAGUuAGUUuAGAUUTsT | 2372 2373 |
| AD-20482.1 | KSP | AUCUAAACUAACUAGAAUC | 2299 | AucuAAAcuAAcuAGAAucTsT GAUUCuAGUuAGUUuAGAUTsT | 2374 2375 |
| AD-20483.1 | KSP | UCUAAACUAACUAGAAUCC | 2300 | ucuAAAcuAAcuAGAAuccTsT GGAUUCuAGUuAGUUuAGATsT | 2376 2377 |
| AD-20484.1 | KSP | CUAAACUAACUAGAAUCCU | 2301 | cuAAAcuAAcuAGAAuccuTsT AGGAUUCuAGUuAGUUuAGTsT | 2378 2379 |
| AD-20485.1 | KSP | UAAACUAACUAGAAUCCUC | 2302 | uAAAcuAAcuAGAAuccucTsT GAGGAUUCuAGUuAGUUuATsT | 2380 2381 |
| AD-20486.1 | KSP | AAACUAACUAGAAUCCUCC | 2303 | AAAcuAAcuAGAAuccuccTsT GGAGGAUUCuAGUuAGUUUTsT | 2382 2383 |

Example 13

VEGF Targeted dsRNA with a Single Blunt End

A set duplexes targeted to VEGF were designed and synthesized. The set included duplexes tiling 10 nucleotides in each direction of the target sites for AD-3133. Each duplex includes a 2 base overhang at the end corresponding to the 3' end of the antisense strand and no overhang, e.g., a blunt end, at the end corresponding to the 5' end of the antisense strand.

The sequences of each strand of these duplexes are shown in the following table.

Each duplex is assayed for inhibition of expression using the assays described herein. The VEGF duplexes are administered alone and/or in combination with an Eg5/KSP dsRNA (e.g., AD-12115). In some embodiments, the dsRNA are administered in a SNALP formulation as described herein.

TABLE 22

Target sequences of blunt ended dsRNA targeted to VEGF

| duplex ID | SEQ ID NO: | VEGF target sequence 5' to 3' | position on VEGF gene |
|---|---|---|---|
| AD-20447.1 | 2384 | ACCAAGGCCAGCACAUAGG | 1365 |
| AD-20448.1 | 2385 | CCAAGGCCAGCACAUAGGA | 1366 |
| AD-20449.1 | 2386 | CAAGGCCAGCACAUAGGAG | 1367 |
| AD-20450.1 | 2387 | AAGGCCAGCACAUAGGAGA | 1368 |
| AD-20451.1 | 2388 | AGGCCAGCACAUAGGAGAG | 1369 |
| AD-20452.1 | 2389 | GGCCAGCACAUAGGAGAGA | 1370 |
| AD-20453.1 | 2390 | GCCAGCACAUAGGAGAGAU | 1371 |

TABLE 22-continued

Target sequences of blunt ended dsRNA targeted to VEGF

| duplex ID | SEQ ID NO: | VEGF target sequence 5' to 3' | position on VEGF gene |
|---|---|---|---|
| AD-20454.1 | 2391 | CCAGCACAUAGGAGAGAUG | 1372 |
| AD-20455.1 | 2392 | CAGCACAUAGGAGAGAUGA | 1373 |
| AD-20456.1 | 2393 | AGCACAUAGGAGAGAUGAG | 1374 |
| AD-20457.1 | 2394 | CACAUAGGAGAGAUGAGCU | 1376 |
| AD-20458.1 | 2395 | ACAUAGGAGAGAUGAGCUU | 1377 |
| AD-20459.1 | 2396 | CAUAGGAGAGAUGAGCUUC | 1378 |
| AD-20460.1 | 2397 | AUAGGAGAGAUGAGCUUCC | 1379 |
| AD-20461.1 | 2398 | UAGGAGAGAUGAGCUUCCU | 1380 |
| AD-20462.1 | 2399 | AGGAGAGAUGAGCUUCCUA | 1381 |
| AD-20463.1 | 2400 | GGAGAGAUGAGCUUCCUAC | 1382 |
| AD-20464.1 | 2401 | GAGAGAUGAGCUUCCUACA | 1383 |
| AD-20465.1 | 2402 | AGAGAUGAGCUUCCUACAG | 1384 |
| AD-20466.1 | 2403 | GAGAUGAGCUUCCUACAGC | 1385 |

TABLE 23

Strand sequences of blunt ended dsRNA targeted to VEGF

| duplex ID | Sense strand (5' to 3') | SEQ ID NO: | Antisense strand (5' to 3') | SEQ ID NO: |
|---|---|---|---|---|
| AD-20447.1 | ACCAAGGCCAGCACAUAGGAG | 2404 | CUCCUAUGUGCUGGCCUUGGUGA | 2424 |
| AD-20448.1 | CCAAGGCCAGCACAUAGGAGA | 2405 | UCUCCUAUGUGCUGGCCUUGGUG | 2425 |
| AD-20449.1 | CAAGGCCAGCACAUAGGAGAG | 2406 | CUCUCCUAUGUGCUGGCCUUGGU | 2426 |
| AD-20450.1 | AAGGCCAGCACAUAGGAGAGA | 2407 | UCUCUCCUAUGUGCUGGCCUUGG | 2427 |
| AD-20451.1 | AGGCCAGCACAUAGGAGAGAU | 2408 | AUCUCUCCUAUGUGCUGGCCUUG | 2428 |
| AD-20452.1 | GGCCAGCACAUAGGAGAGAUG | 2409 | CAUCUCUCCUAUGUGCUGGCCUU | 2429 |
| AD-20453.1 | GCCAGCACAUAGGAGAGAUGA | 2410 | UCAUCUCUCCUAUGUGCUGGCCU | 2430 |
| AD-20454.1 | CCAGCACAUAGGAGAGAUGAG | 2411 | CUCAUCUCUCCUAUGUGCUGGCC | 2431 |
| AD-20455.1 | CAGCACAUAGGAGAGAUGAGC | 2412 | GCUCAUCUCUCCUAUGUGCUGGC | 2432 |
| AD-20456.1 | AGCACAUAGGAGAGAUGAGCU | 2413 | AGCUCAUCUCUCCUAUGUGCUGG | 2433 |
| AD-20457.1 | CACAUAGGAGAGAUGAGCUUC | 2414 | GAAGCUCAUCUCUCCUAUGUGCU | 2434 |
| AD-20458.1 | ACAUAGGAGAGAUGAGCUUCC | 2415 | GGAAGCUCAUCUCUCCUAUGUGC | 2435 |
| AD-20459.1 | CAUAGGAGAGAUGAGCUUCCU | 2416 | AGGAAGCUCAUCUCUCCUAUGUG | 2436 |
| AD-20460.1 | AUAGGAGAGAUGAGCUUCCUA | 2417 | UAGGAAGCUCAUCUCUCCUAUGU | 2437 |
| AD-20461.1 | UAGGAGAGAUGAGCUUCCUAC | 2418 | GUAGGAAGCUCAUCUCUCCUAUG | 2438 |
| AD-20462.1 | AGGAGAGAUGAGCUUCCUACA | 2419 | UGUAGGAAGCUCAUCUCUCCUAU | 2439 |
| AD-20463.1 | GGAGAGAUGAGCUUCCUACAG | 2420 | CUGUAGGAAGCUCAUCUCUCCUA | 2440 |
| AD-20464.1 | GAGAGAUGAGCUUCCUACAGC | 2421 | GCUGUAGGAAGCUCAUCUCUCCU | 2441 |
| AD-20465.1 | AGAGAUGAGCUUCCUACAGCA | 2422 | UGCUGUAGGAAGCUCAUCUCUCC | 2442 |
| AD-20466.1 | GAGAUGAGCUUCCUACAGCAC | 2423 | GUGCUGUAGGAAGCUCAUCUCUC | 2443 |

Example 14

Inhibition of Eg5/KSP and VEGF Expression in Humans

A human subject is treated with a pharmaceutical composition, e.g., ALNVSP02, having both a SNALP formulated dsRNA targeted to a Eg5/KSP gene and a SNALP formulated dsRNA targeted to a VEGF gene to inhibit expression of the Eg5/KSP and VEGF genes.

A subject in need of treatment is selected or identified. The subject can be in need of cancer treatment, e.g., liver cancer.

At time zero, a suitable first dose of the composition is subcutaneously administered to the subject. The composition is formulated as described herein. After a period of time, the subject's condition is evaluated, e.g., by measurement of tumor growth, measuring serum AFP levels, and the like. This measurement can be accompanied by a measurement of Eg5/KSP and/or VEGF expression in said subject, and/or the products of the successful siRNA-targeting of Eg5/KSP and/or VEGF mRNA. Other relevant criteria can also be measured. The number and strength of doses are adjusted according to the subject's needs.

After treatment, the subject's condition is compared to the condition existing prior to the treatment, or relative to the condition of a similarly afflicted but untreated subject.

Those skilled in the art are familiar with methods and compositions in addition to those specifically set out in the present disclosure which will allow them to practice this invention to the full scope of the claims hereinafter appended.

SEQUENCE LISTING (2443 sequences)

SEQ ID NO: 1 - DNA, 21 bp, Artificial Sequence
  Description of Combined DNA/RNA Molecule: Synthetic oligonucleotide
  Description of Artificial Sequence: Synthetic oligonucleotide
cgaaguguuguuuguccaatt

SEQ ID NO: 2 - DNA, 21 bp, Artificial Sequence
  Description of Combined DNA/RNA Molecule: Synthetic oligonucleotide
  Description of Artificial Sequence: Synthetic oligonucleotide
uuggacaaacaacacuucgtt

SEQ ID NO: 3 - DNA, 21 bp, Artificial Sequence
  Description of Combined DNA/RNA Molecule: Synthetic oligonucleotide
  Description of Artificial Sequence: Synthetic oligonucleotide
ugguguuuggagcaucuactt

SEQ ID NO: 4 - DNA, 21 bp, Artificial Sequence
  Description of Combined DNA/RNA Molecule: Synthetic oligonucleotide
  Description of Artificial Sequence: Synthetic oligonucleotide
guagaugcuccaaacaccatt

SEQ ID NO: 5 - DNA, 21 bp, Artificial Sequence
  Description of Combined DNA/RNA Molecule: Synthetic oligonucleotide
  Description of Artificial Sequence: Synthetic oligonucleotide
ucuaaacuaacuagaaucctt

SEQ ID NO: 6 - DNA, 21 bp, Artificial Sequence
  Description of Combined DNA/RNA Molecule: Synthetic oligonucleotide
  Description of Artificial Sequence: Synthetic oligonucleotide
ggauucuaguuaguuuagatt

SEQ ID NO: 7 - DNA, 21 bp, Artificial Sequence
  Description of Combined DNA/RNA Molecule: Synthetic oligonucleotide
  Description of Artificial Sequence: Synthetic oligonucleotide
cuuaucgagaaucuaaacutt

SEQ ID NO: 8 - DNA, 21 bp, Artificial Sequence
  Description of Combined DNA/RNA Molecule: Synthetic oligonucleotide
  Description of Artificial Sequence: Synthetic oligonucleotide
aguuuagauucucgauaagtt

SEQ ID NO: 9 - DNA, 21 bp, Artificial Sequence
  Description of Combined DNA/RNA Molecule: Synthetic oligonucleotide
  Description of Artificial Sequence: Synthetic oligonucleotide
uugauguuuaccgaagugutt

SEQ ID NO: 10 - DNA, 21 bp, Artificial Sequence
  Description of Combined DNA/RNA Molecule: Synthetic oligonucleotide
  Description of Artificial Sequence: Synthetic oligonucleotide
acacuucgguaaacaucaatt

SEQ ID NO: 11 - DNA, 21 bp, Artificial Sequence
  Description of Combined DNA/RNA Molecule: Synthetic oligonucleotide
  Description of Artificial Sequence: Synthetic oligonucleotide
gugagaugcagaccauuuatt

SEQ ID NO: 12 - DNA, 21 bp, Artificial Sequence
  Description of Combined DNA/RNA Molecule: Synthetic oligonucleotide
  Description of Artificial Sequence: Synthetic oligonucleotide
uaaauggucugcaucucactt

SEQ ID NO: 13 - DNA, 21 bp, Artificial Sequence
  Description of Combined DNA/RNA Molecule: Synthetic oligonucleotide
  Description of Artificial Sequence: Synthetic oligonucleotide
ucugaguacauuggaauautt

SEQ ID NO: 14 - DNA, 21 bp, Artificial Sequence
  Description of Combined DNA/RNA Molecule: Synthetic oligonucleotide
  Description of Artificial Sequence: Synthetic oligonucleotide
auauuccaauguacucagatt

SEQ ID NO: 15 - DNA, 21 bp, Artificial Sequence
  Description of Combined DNA/RNA Molecule: Synthetic oligonucleotide
  Description of Artificial Sequence: Synthetic oligonucleotide
gaaguguuguuuguccaautt

SEQ ID NO: 16 - DNA, 21 bp, Artificial Sequence
  Description of Combined DNA/RNA Molecule: Synthetic oligonucleotide
  Description of Artificial Sequence: Synthetic oligonucleotide
auuggacaaacaacacuuctt

SEQ ID NO: 17 - DNA, 21 bp, Artificial Sequence
  Description of Combined DNA/RNA Molecule: Synthetic oligonucleotide
  Description of Artificial Sequence: Synthetic oligonucleotide
uuauuaugggcuauaauugtt

SEQ ID NO: 18 - DNA, 21 bp, Artificial Sequence
  Description of Combined DNA/RNA Molecule: Synthetic oligonucleotide
  Description of Artificial Sequence: Synthetic oligonucleotide
caauuauagcccauaauaatt

SEQ ID NO: 19 - DNA, 21 bp, Artificial Sequence
  Description of Combined DNA/RNA Molecule: Synthetic oligonucleotide
  Description of Artificial Sequence: Synthetic oligonucleotide
aaggugaaaggucaccuaatt

SEQ ID NO: 20 - DNA, 21 bp, Artificial Sequence
  Description of Combined DNA/RNA Molecule: Synthetic oligonucleotide
  Description of Artificial Sequence: Synthetic oligonucleotide
uuaggugaccuuucaccuutt

SEQ ID NO: 21 - DNA, 21 bp, Artificial Sequence
  Description of Combined DNA/RNA Molecule: Synthetic oligonucleotide
  Description of Artificial Sequence: Synthetic oligonucleotide
uuacaauggaaggugaaagtt

SEQ ID NO: 22 - DNA, 21 bp, Artificial Sequence
  Description of Combined DNA/RNA Molecule: Synthetic oligonucleotide
  Description of Artificial Sequence: Synthetic oligonucleotide
cuuucaccuuccauuguaatt

SEQ ID NO: 23 - DNA, 21 bp, Artificial Sequence
  Description of Combined DNA/RNA Molecule: Synthetic oligonucleotide
  Description of Artificial Sequence: Synthetic oligonucleotide
aggugaaaggucaccuaautt

SEQ ID NO: 24 - DNA, 21 bp, Artificial Sequence
  Description of Combined DNA/RNA Molecule: Synthetic oligonucleotide
  Description of Artificial Sequence: Synthetic oligonucleotide
auuaggugaccuuucaccutt

SEQ ID NO: 25 - DNA, 21 bp, Artificial Sequence
  Description of Combined DNA/RNA Molecule: Synthetic oligonucleotide
  Description of Artificial Sequence: Synthetic oligonucleotide
ggugaaaggucaccuaaugtt

SEQ ID NO: 26 - DNA, 21 bp, Artificial Sequence
  Description of Combined DNA/RNA Molecule: Synthetic oligonucleotide
  Description of Artificial Sequence: Synthetic oligonucleotide
cauuaggugaccuuucacctt

SEQ ID NO: 27 - DNA, 21 bp, Artificial Sequence
  Description of Combined DNA/RNA Molecule: Synthetic oligonucleotide
  Description of Artificial Sequence: Synthetic oligonucleotide
ccuuaucgagaaucuaaactt

SEQ ID NO: 28 - DNA, 21 bp, Artificial Sequence
  Description of Combined DNA/RNA Molecule: Synthetic oligonucleotide
  Description of Artificial Sequence: Synthetic oligonucleotide
guuuagauucucgauaaggtt

SEQ ID NO: 29 - DNA, 21 bp, Artificial Sequence
  Description of Combined DNA/RNA Molecule: Synthetic oligonucleotide
  Description of Artificial Sequence: Synthetic oligonucleotide
cucuuauuaaggaguauactt

SEQ ID NO: 30 - DNA, 21 bp, Artificial Sequence
  Description of Combined DNA/RNA Molecule: Synthetic oligonucleotide
  Description of Artificial Sequence: Synthetic oligonucleotide
guauacuccuuaauaagagtt

SEQ ID NO: 31 - DNA, 21 bp, Artificial Sequence
  Description of Combined DNA/RNA Molecule: Synthetic oligonucleotide
  Description of Artificial Sequence: Synthetic oligonucleotide
gagagauucugugcuuuggtt

SEQ ID NO: 32 - DNA, 21 bp, Artificial Sequence
  Description of Combined DNA/RNA Molecule: Synthetic oligonucleotide
  Description of Artificial Sequence: Synthetic oligonucleotide
ccaaagcacagaaucucuctt

SEQ ID NO: 33 - DNA, 21 bp, Artificial Sequence
  Description of Combined DNA/RNA Molecule: Synthetic oligonucleotide
  Description of Artificial Sequence: Synthetic oligonucleotide
aucuaaacuaacuagaauctt

SEQ ID NO: 34 - DNA, 21 bp, Artificial Sequence
  Description of Combined DNA/RNA Molecule: Synthetic oligonucleotide
  Description of Artificial Sequence: Synthetic oligonucleotide
gauucuaguuaguuuagautt

SEQ ID NO: 35 - DNA, 21 bp, Artificial Sequence
  Description of Combined DNA/RNA Molecule: Synthetic oligonucleotide
  Description of Artificial Sequence: Synthetic oligonucleotide
ucaccaaaaaagcucuuautt

SEQ ID NO: 36 - DNA, 21 bp, Artificial Sequence
  Description of Combined DNA/RNA Molecule: Synthetic oligonucleotide
  Description of Artificial Sequence: Synthetic oligonucleotide
auaagagcuuuuuuggugatt

SEQ ID NO: 37 - DNA, 21 bp, Artificial Sequence
  Description of Combined DNA/RNA Molecule: Synthetic oligonucleotide
  Description of Artificial Sequence: Synthetic oligonucleotide
gagcuuuuugaucuucuuatt

SEQ ID NO: 38 - DNA, 21 bp, Artificial Sequence
  Description of Combined DNA/RNA Molecule: Synthetic oligonucleotide
  Description of Artificial Sequence: Synthetic oligonucleotide
uaagaagaucaaaaagcuctt

SEQ ID NO: 39 - DNA, 21 bp, Artificial Sequence
  Description of Combined DNA/RNA Molecule: Synthetic oligonucleotide
  Description of Artificial Sequence: Synthetic oligonucleotide
cguacaagaacaucuauaatt

SEQ ID NO: 40 - DNA, 21 bp, Artificial Sequence
  Description of Combined DNA/RNA Molecule: Synthetic oligonucleotide
  Description of Artificial Sequence: Synthetic oligonucleotide
uuauagauguucuuguacgtt

SEQ ID NO: 41 - DNA, 21 bp, Artificial Sequence
  Description of Combined DNA/RNA Molecule: Synthetic oligonucleotide
  Description of Artificial Sequence: Synthetic oligonucleotide
auugauguuuaccgaagugtt

SEQ ID NO: 42 - DNA, 21 bp, Artificial Sequence
  Description of Combined DNA/RNA Molecule: Synthetic oligonucleotide
  Description of Artificial Sequence: Synthetic oligonucleotide
cacuucgguaaacaucaautt

SEQ ID NO: 43 - DNA, 21 bp, Artificial Sequence
  Description of Combined DNA/RNA Molecule: Synthetic oligonucleotide
  Description of Artificial Sequence: Synthetic oligonucleotide
cuaaacuaacuagaauccutt

SEQ ID NO: 44 - DNA, 21 bp, Artificial Sequence
  Description of Combined DNA/RNA Molecule: Synthetic oligonucleotide
  Description of Artificial Sequence: Synthetic oligonucleotide
aggauucuaguuaguuuagtt

SEQ ID NO: 45 - DNA, 21 bp, Artificial Sequence
  Description of Combined DNA/RNA Molecule: Synthetic oligonucleotide
  Description of Artificial Sequence: Synthetic oligonucleotide
accgaaguguuguuugucctt

SEQ ID NO: 46 - DNA, 21 bp, Artificial Sequence
  Description of Combined DNA/RNA Molecule: Synthetic oligonucleotide
  Description of Artificial Sequence: Synthetic oligonucleotide
ggacaaacaacacuucggutt

SEQ ID NO: 47 - DNA, 21 bp, Artificial Sequence
  Description of Combined DNA/RNA Molecule: Synthetic oligonucleotide
  Description of Artificial Sequence: Synthetic oligonucleotide
ugguggugagaugcagacctt

SEQ ID NO: 48 - DNA, 21 bp, Artificial Sequence
  Description of Combined DNA/RNA Molecule: Synthetic oligonucleotide
  Description of Artificial Sequence: Synthetic oligonucleotide
ggucugcaucucaccaccatt

SEQ ID NO: 49 - DNA, 21 bp, Artificial Sequence
  Description of Combined DNA/RNA Molecule: Synthetic oligonucleotide
  Description of Artificial Sequence: Synthetic oligonucleotide
cauacucuagucguucccatt

SEQ ID NO: 50 - DNA, 21 bp, Artificial Sequence
  Description of Combined DNA/RNA Molecule: Synthetic oligonucleotide
  Description of Artificial Sequence: Synthetic oligonucleotide
ugggaacgacuagaguaugtt

SEQ ID NO: 51 - DNA, 21 bp, Artificial Sequence
  Description of Combined DNA/RNA Molecule: Synthetic oligonucleotide
  Description of Artificial Sequence: Synthetic oligonucleotide
agcgcccauucaauaguagtt

SEQ ID NO: 52 - DNA, 21 bp, Artificial Sequence
  Description of Combined DNA/RNA Molecule: Synthetic oligonucleotide
  Description of Artificial Sequence: Synthetic oligonucleotide
cuacuauugaaugggcgcutt

SEQ ID NO: 53 - DNA, 21 bp, Artificial Sequence
  Description of Combined DNA/RNA Molecule: Synthetic oligonucleotide
  Description of Artificial Sequence: Synthetic oligonucleotide
ggaaagcuagcgcccauuctt

SEQ ID NO: 54 - DNA, 21 bp, Artificial Sequence
  Description of Combined DNA/RNA Molecule: Synthetic oligonucleotide
  Description of Artificial Sequence: Synthetic oligonucleotide
gaaugggcgcuagcuuucctt

SEQ ID NO: 55 - DNA, 21 bp, Artificial Sequence
  Description of Combined DNA/RNA Molecule: Synthetic oligonucleotide
  Description of Artificial Sequence: Synthetic oligonucleotide
gaaagcuagcgcccauucatt

SEQ ID NO: 56 - DNA, 21 bp, Artificial Sequence
  Description of Combined DNA/RNA Molecule: Synthetic oligonucleotide
  Description of Artificial Sequence: Synthetic oligonucleotide
ugaaugggcgcuagcuuuctt

SEQ ID NO: 57 - DNA, 21 bp, Artificial Sequence
  Description of Combined DNA/RNA Molecule: Synthetic oligonucleotide
  Description of Artificial Sequence: Synthetic oligonucleotide
agaaacuacgauugauggatt

SEQ ID NO: 58 - DNA, 21 bp, Artificial Sequence
  Description of Combined DNA/RNA Molecule: Synthetic oligonucleotide
  Description of Artificial Sequence: Synthetic oligonucleotide
uccaucaaucguaguuucutt

SEQ ID NO: 59 - DNA, 21 bp, Artificial Sequence
  Description of Combined DNA/RNA Molecule: Synthetic oligonucleotide
  Description of Artificial Sequence: Synthetic oligonucleotide
uguuccuuaucgagaaucutt

SEQ ID NO: 60 - DNA, 21 bp, Artificial Sequence
  Description of Combined DNA/RNA Molecule: Synthetic oligonucleotide
  Description of Artificial Sequence: Synthetic oligonucleotide
agauucucgauaaggaacatt

SEQ ID NO: 61 - DNA, 21 bp, Artificial Sequence
  Description of Combined DNA/RNA Molecule: Synthetic oligonucleotide
  Description of Artificial Sequence: Synthetic oligonucleotide
cagauuaccucugcgagcctt

SEQ ID NO: 62 - DNA, 21 bp, Artificial Sequence
  Description of Combined DNA/RNA Molecule: Synthetic oligonucleotide
  Description of Artificial Sequence: Synthetic oligonucleotide
ggcucgcagagguaaucugtt

SEQ ID NO: 63 - DNA, 21 bp, Artificial Sequence
  Description of Combined DNA/RNA Molecule: Synthetic oligonucleotide
  Description of Artificial Sequence: Synthetic oligonucleotide
gcgcccauucaauaguagatt

SEQ ID NO: 64 - DNA, 21 bp, Artificial Sequence
  Description of Combined DNA/RNA Molecule: Synthetic oligonucleotide
  Description of Artificial Sequence: Synthetic oligonucleotide
ucuacuauugaaugggcgctt

SEQ ID NO: 65 - DNA, 21 bp, Artificial Sequence
  Description of Combined DNA/RNA Molecule: Synthetic oligonucleotide
  Description of Artificial Sequence: Synthetic oligonucleotide
uugcacuaucuuugcguautt

SEQ ID NO: 66 - DNA, 21 bp, Artificial Sequence
  Description of Combined DNA/RNA Molecule: Synthetic oligonucleotide
  Description of Artificial Sequence: Synthetic oligonucleotide
auacgcaaagauagugcaatt

SEQ ID NO: 67 - DNA, 21 bp, Artificial Sequence
  Description of Combined DNA/RNA Molecule: Synthetic oligonucleotide
  Description of Artificial Sequence: Synthetic oligonucleotide
cagagcggaaagcuagcgctt

SEQ ID NO: 68 - DNA, 21 bp, Artificial Sequence
  Description of Combined DNA/RNA Molecule: Synthetic oligonucleotide
  Description of Artificial Sequence: Synthetic oligonucleotide
gcgcuagcuuuccgcucugtt

SEQ ID NO: 69 - DNA, 21 bp, Artificial Sequence
  Description of Combined DNA/RNA Molecule: Synthetic oligonucleotide
  Description of Artificial Sequence: Synthetic oligonucleotide
agaccuuauuugguaaucutt

SEQ ID NO: 70 - DNA, 21 bp, Artificial Sequence
  Description of Combined DNA/RNA Molecule: Synthetic oligonucleotide
  Description of Artificial Sequence: Synthetic oligonucleotide
agauuaccaaauaaggucutt

SEQ ID NO: 71 - DNA, 21 bp, Artificial Sequence
  Description of Combined DNA/RNA Molecule: Synthetic oligonucleotide
  Description of Artificial Sequence: Synthetic oligonucleotide
auucucuuggagggcguactt

SEQ ID NO: 72 - DNA, 21 bp, Artificial Sequence
  Description of Combined DNA/RNA Molecule: Synthetic oligonucleotide
  Description of Artificial Sequence: Synthetic oligonucleotide
guacgcccuccaagagaautt

SEQ ID NO: 73 - DNA, 21 bp, Artificial Sequence
  Description of Combined DNA/RNA Molecule: Synthetic oligonucleotide
  Description of Artificial Sequence: Synthetic oligonucleotide
ggcugguauaauuccacgutt

SEQ ID NO: 74 - DNA, 21 bp, Artificial Sequence
  Description of Combined DNA/RNA Molecule: Synthetic oligonucleotide
  Description of Artificial Sequence: Synthetic oligonucleotide
acguggaauuauaccagcctt

SEQ ID NO: 75 - DNA, 21 bp, Artificial Sequence
  Description of Combined DNA/RNA Molecule: Synthetic oligonucleotide
  Description of Artificial Sequence: Synthetic oligonucleotide
gcggaaagcuagcgcccautt

SEQ ID NO: 76 - DNA, 21 bp, Artificial Sequence
  Description of Combined DNA/RNA Molecule: Synthetic oligonucleotide
  Description of Artificial Sequence: Synthetic oligonucleotide
augggcgcuagcuuuccgctt

SEQ ID NO: 77 - DNA, 21 bp, Artificial Sequence
  Description of Combined DNA/RNA Molecule: Synthetic oligonucleotide
  Description of Artificial Sequence: Synthetic oligonucleotide
ugcacuaucuuugcguaugtt

SEQ ID NO: 78 - DNA, 21 bp, Artificial Sequence
  Description of Combined DNA/RNA Molecule: Synthetic oligonucleotide
  Description of Artificial Sequence: Synthetic oligonucleotide
cauacgcaaagauagugcatt

SEQ ID NO: 79 - DNA, 21 bp, Artificial Sequence
  Description of Combined DNA/RNA Molecule: Synthetic oligonucleotide
  Description of Artificial Sequence: Synthetic oligonucleotide
guauaauuccacguacccutt

SEQ ID NO: 80 - DNA, 21 bp, Artificial Sequence
  Description of Combined DNA/RNA Molecule: Synthetic oligonucleotide
  Description of Artificial Sequence: Synthetic oligonucleotide
aggguacguggaauuauactt

SEQ ID NO: 81 - DNA, 21 bp, Artificial Sequence
  Description of Combined DNA/RNA Molecule: Synthetic oligonucleotide
  Description of Artificial Sequence: Synthetic oligonucleotide
agaaucuaaacuaacuagatt

SEQ ID NO: 82 - DNA, 21 bp, Artificial Sequence
  Description of Combined DNA/RNA Molecule: Synthetic oligonucleotide
  Description of Artificial Sequence: Synthetic oligonucleotide
ucuaguuaguuuagauucutt

SEQ ID NO: 83 - DNA, 21 bp, Artificial Sequence
  Description of Combined DNA/RNA Molecule: Synthetic oligonucleotide
  Description of Artificial Sequence: Synthetic oligonucleotide
aggagcugaauaggguuactt

SEQ ID NO: 84 - DNA, 21 bp, Artificial Sequence
  Description of Combined DNA/RNA Molecule: Synthetic oligonucleotide
  Description of Artificial Sequence: Synthetic oligonucleotide
guaacccuauucagcuccutt

SEQ ID NO: 85 - DNA, 21 bp, Artificial Sequence
  Description of Combined DNA/RNA Molecule: Synthetic oligonucleotide
  Description of Artificial Sequence: Synthetic oligonucleotide
gaaguacauaagaccuuautt

SEQ ID NO: 86 - DNA, 21 bp, Artificial Sequence
  Description of Combined DNA/RNA Molecule: Synthetic oligonucleotide
  Description of Artificial Sequence: Synthetic oligonucleotide
auaaggucuuauguacuuctt

SEQ ID NO: 87 - DNA, 21 bp, Artificial Sequence
  Description of Combined DNA/RNA Molecule: Synthetic oligonucleotide
  Description of Artificial Sequence: Synthetic oligonucleotide
gacaguggccgauaagauatt

SEQ ID NO: 88 - DNA, 21 bp, Artificial Sequence
  Description of Combined DNA/RNA Molecule: Synthetic oligonucleotide
  Description of Artificial Sequence: Synthetic oligonucleotide
uaucuuaucggccacuguctt

SEQ ID NO: 89 - DNA, 21 bp, Artificial Sequence
  Description of Combined DNA/RNA Molecule: Synthetic oligonucleotide
  Description of Artificial Sequence: Synthetic oligonucleotide
aaaccacuuaguagugucctt

SEQ ID NO: 90 - DNA, 21 bp, Artificial Sequence
  Description of Combined DNA/RNA Molecule: Synthetic oligonucleotide
  Description of Artificial Sequence: Synthetic oligonucleotide
ggacacuacuaagugguuutt

SEQ ID NO: 91 - DNA, 21 bp, Artificial Sequence
  Description of Combined DNA/RNA Molecule: Synthetic oligonucleotide
  Description of Artificial Sequence: Synthetic oligonucleotide
ucccuagacuucccuauuutt

SEQ ID NO: 92 - DNA, 21 bp, Artificial Sequence
  Description of Combined DNA/RNA Molecule: Synthetic oligonucleotide
  Description of Artificial Sequence: Synthetic oligonucleotide
aaauagggaagucuagggatt

SEQ ID NO: 93 - DNA, 21 bp, Artificial Sequence
  Description of Combined DNA/RNA Molecule: Synthetic oligonucleotide
  Description of Artificial Sequence: Synthetic oligonucleotide
uagacuucccuauuucgcutt

SEQ ID NO: 94 - DNA, 21 bp, Artificial Sequence
  Description of Combined DNA/RNA Molecule: Synthetic oligonucleotide
  Description of Artificial Sequence: Synthetic oligonucleotide
agcgaaauagggaagucuatt

SEQ ID NO: 95 - DNA, 21 bp, Artificial Sequence
  Description of Combined DNA/RNA Molecule: Synthetic oligonucleotide
  Description of Artificial Sequence: Synthetic oligonucleotide
gcgucgcagccaaauucgutt

SEQ ID NO: 96 - DNA, 21 bp, Artificial Sequence
  Description of Combined DNA/RNA Molecule: Synthetic oligonucleotide
  Description of Artificial Sequence: Synthetic oligonucleotide
acgaauuuggcugcgacgctt

SEQ ID NO: 97 - DNA, 21 bp, Artificial Sequence
  Description of Combined DNA/RNA Molecule: Synthetic oligonucleotide
  Description of Artificial Sequence: Synthetic oligonucleotide
agcuagcgcccauucaauatt

SEQ ID NO: 98 - DNA, 21 bp, Artificial Sequence
  Description of Combined DNA/RNA Molecule: Synthetic oligonucleotide
  Description of Artificial Sequence: Synthetic oligonucleotide
uauugaaugggcgcuagcutt

SEQ ID NO: 99 - DNA, 21 bp, Artificial Sequence
  Description of Combined DNA/RNA Molecule: Synthetic oligonucleotide
  Description of Artificial Sequence: Synthetic oligonucleotide
gaaacuacgauugauggagtt

SEQ ID NO: 100 - DNA, 21 bp, Artificial Sequence
  Description of Combined DNA/RNA Molecule: Synthetic oligonucleotide
  Description of Artificial Sequence: Synthetic oligonucleotide
cuccaucaaucguaguuuctt

SEQ ID NO: 101 - DNA, 21 bp, Artificial Sequence
  Description of Combined DNA/RNA Molecule: Synthetic oligonucleotide
  Description of Artificial Sequence: Synthetic oligonucleotide
ccgauaagauagaagaucatt

SEQ ID NO: 102 - DNA, 21 bp, Artificial Sequence
  Description of Combined DNA/RNA Molecule: Synthetic oligonucleotide
  Description of Artificial Sequence: Synthetic oligonucleotide
ugaucuucuaucuuaucggtt

SEQ ID NO: 103 - DNA, 21 bp, Artificial Sequence
  Description of Combined DNA/RNA Molecule: Synthetic oligonucleotide
  Description of Artificial Sequence: Synthetic oligonucleotide
uagcgcccauucaauaguatt

SEQ ID NO: 104 - DNA, 21 bp, Artificial Sequence
  Description of Combined DNA/RNA Molecule: Synthetic oligonucleotide
  Description of Artificial Sequence: Synthetic oligonucleotide
uacuauugaaugggcgcuatt

SEQ ID NO: 105 - DNA, 21 bp, Artificial Sequence
  Description of Combined DNA/RNA Molecule: Synthetic oligonucleotide
  Description of Artificial Sequence: Synthetic oligonucleotide
uuugcguauggccaaacugtt

SEQ ID NO: 106 - DNA, 21 bp, Artificial Sequence
  Description of Combined DNA/RNA Molecule: Synthetic oligonucleotide
  Description of Artificial Sequence: Synthetic oligonucleotide
caguuuggccauacgcaaatt

SEQ ID NO: 107 - DNA, 21 bp, Artificial Sequence
  Description of Combined DNA/RNA Molecule: Synthetic oligonucleotide
  Description of Artificial Sequence: Synthetic oligonucleotide
cacguacccuucaucaaautt

SEQ ID NO: 108 - DNA, 21 bp, Artificial Sequence
  Description of Combined DNA/RNA Molecule: Synthetic oligonucleotide
  Description of Artificial Sequence: Synthetic oligonucleotide
auuugaugaaggguacgugtt

SEQ ID NO: 109 - DNA, 21 bp, Artificial Sequence
  Description of Combined DNA/RNA Molecule: Synthetic oligonucleotide
  Description of Artificial Sequence: Synthetic oligonucleotide
ucuuugcguauggccaaactt

SEQ ID NO: 110 - DNA, 21 bp, Artificial Sequence
  Description of Combined DNA/RNA Molecule: Synthetic oligonucleotide
  Description of Artificial Sequence: Synthetic oligonucleotide
guuuggccauacgcaaagatt

SEQ ID NO: 111 - DNA, 21 bp, Artificial Sequence
  Description of Combined DNA/RNA Molecule: Synthetic oligonucleotide
  Description of Artificial Sequence: Synthetic oligonucleotide
ccgaaguguuguuuguccatt

SEQ ID NO: 112 - DNA, 21 bp, Artificial Sequence
  Description of Combined DNA/RNA Molecule: Synthetic oligonucleotide
  Description of Artificial Sequence: Synthetic oligonucleotide
uggacaaacaacacuucggtt

SEQ ID NO: 113 - DNA, 21 bp, Artificial Sequence
  Description of Combined DNA/RNA Molecule: Synthetic oligonucleotide
  Description of Artificial Sequence: Synthetic oligonucleotide
agagcggaaagcuagcgcctt

SEQ ID NO: 114 - DNA, 21 bp, Artificial Sequence
  Description of Combined DNA/RNA Molecule: Synthetic oligonucleotide
  Description of Artificial Sequence: Synthetic oligonucleotide
ggcgcuagcuuuccgcucutt

SEQ ID NO: 115 - DNA, 21 bp, Artificial Sequence
  Description of Combined DNA/RNA Molecule: Synthetic oligonucleotide
  Description of Artificial Sequence: Synthetic oligonucleotide
gcuagcgcccauucaauagtt

SEQ ID NO: 116 - DNA, 21 bp, Artificial Sequence
  Description of Combined DNA/RNA Molecule: Synthetic oligonucleotide
  Description of Artificial Sequence: Synthetic oligonucleotide
cuauugaaugggcgcuagctt

SEQ ID NO: 117 - DNA, 21 bp, Artificial Sequence
  Description of Combined DNA/RNA Molecule: Synthetic oligonucleotide
  Description of Artificial Sequence: Synthetic oligonucleotide
aaguuaguguacgaacuggtt

SEQ ID NO: 118 - DNA, 21 bp, Artificial Sequence
  Description of Combined DNA/RNA Molecule: Synthetic oligonucleotide
  Description of Artificial Sequence: Synthetic oligonucleotide
ccaguucguacacuaacuutt

SEQ ID NO: 119 - DNA, 21 bp, Artificial Sequence
  Description of Combined DNA/RNA Molecule: Synthetic oligonucleotide
  Description of Artificial Sequence: Synthetic oligonucleotide
guacgaacuggaggauuggtt

SEQ ID NO: 120 - DNA, 21 bp, Artificial Sequence
  Description of Combined DNA/RNA Molecule: Synthetic oligonucleotide
  Description of Artificial Sequence: Synthetic oligonucleotide
ccaauccuccaguucguactt

SEQ ID NO: 121 - DNA, 21 bp, Artificial Sequence
  Description of Combined DNA/RNA Molecule: Synthetic oligonucleotide
  Description of Artificial Sequence: Synthetic oligonucleotide
acgaacuggaggauuggcutt

SEQ ID NO: 122 - DNA, 21 bp, Artificial Sequence
  Description of Combined DNA/RNA Molecule: Synthetic oligonucleotide
  Description of Artificial Sequence: Synthetic oligonucleotide
agccaauccuccaguucgutt

SEQ ID NO: 123 - DNA, 21 bp, Artificial Sequence
  Description of Combined DNA/RNA Molecule: Synthetic oligonucleotide
  Description of Artificial Sequence: Synthetic oligonucleotide
agauugauguuuaccgaagtt

SEQ ID NO: 124 - DNA, 21 bp, Artificial Sequence
  Description of Combined DNA/RNA Molecule: Synthetic oligonucleotide
  Description of Artificial Sequence: Synthetic oligonucleotide
cuucgguaaacaucaaucutt

SEQ ID NO: 125 - DNA, 21 bp, Artificial Sequence
  Description of Combined DNA/RNA Molecule: Synthetic oligonucleotide
  Description of Artificial Sequence: Synthetic oligonucleotide
uaugggcuauaauugcacutt

SEQ ID NO: 126 - DNA, 21 bp, Artificial Sequence
  Description of Combined DNA/RNA Molecule: Synthetic oligonucleotide
  Description of Artificial Sequence: Synthetic oligonucleotide
agugcaauuauagcccauatt

SEQ ID NO: 127 - DNA, 21 bp, Artificial Sequence
  Description of Combined DNA/RNA Molecule: Synthetic oligonucleotide
  Description of Artificial Sequence: Synthetic oligonucleotide
aucuuugcguauggccaaatt

SEQ ID NO: 128 - DNA, 21 bp, Artificial Sequence
  Description of Combined DNA/RNA Molecule: Synthetic oligonucleotide
  Description of Artificial Sequence: Synthetic oligonucleotide
uuuggccauacgcaaagautt

SEQ ID NO: 129 - DNA, 21 bp, Artificial Sequence
  Description of Combined DNA/RNA Molecule: Synthetic oligonucleotide
  Description of Artificial Sequence: Synthetic oligonucleotide
acucuagucguucccacuctt

SEQ ID NO: 130 - DNA, 21 bp, Artificial Sequence
  Description of Combined DNA/RNA Molecule: Synthetic oligonucleotide
  Description of Artificial Sequence: Synthetic oligonucleotide
gagugggaacgacuagagutt

SEQ ID NO: 131 - DNA, 21 bp, Artificial Sequence
  Description of Combined DNA/RNA Molecule: Synthetic oligonucleotide
  Description of Artificial Sequence: Synthetic oligonucleotide
aacuacgauugauggagaatt

SEQ ID NO: 132 - DNA, 21 bp, Artificial Sequence
  Description of Combined DNA/RNA Molecule: Synthetic oligonucleotide
  Description of Artificial Sequence: Synthetic oligonucleotide
uucuccaucaaucguaguutt

SEQ ID NO: 133 - DNA, 21 bp, Artificial Sequence
  Description of Combined DNA/RNA Molecule: Synthetic oligonucleotide
  Description of Artificial Sequence: Synthetic oligonucleotide
gauaagagagcucgggaagtt

SEQ ID NO: 134 - DNA, 21 bp, Artificial Sequence
  Description of Combined DNA/RNA Molecule: Synthetic oligonucleotide
  Description of Artificial Sequence: Synthetic oligonucleotide
cuucccgagcucucuuauctt

SEQ ID NO: 135 - DNA, 21 bp, Artificial Sequence
  Description of Combined DNA/RNA Molecule: Synthetic oligonucleotide
  Description of Artificial Sequence: Synthetic oligonucleotide
ucgagaaucuaaacuaacutt

SEQ ID NO: 136 - DNA, 21 bp, Artificial Sequence
  Description of Combined DNA/RNA Molecule: Synthetic oligonucleotide
  Description of Artificial Sequence: Synthetic oligonucleotide
aguuaguuuagauucucgatt

SEQ ID NO: 137 - DNA, 21 bp, Artificial Sequence
  Description of Combined DNA/RNA Molecule: Synthetic oligonucleotide
  Description of Artificial Sequence: Synthetic oligonucleotide
aacuaacuagaauccuccatt

SEQ ID NO: 138 - DNA, 21 bp, Artificial Sequence
  Description of Combined DNA/RNA Molecule: Synthetic oligonucleotide
  Description of Artificial Sequence: Synthetic oligonucleotide
uggaggauucuaguuaguutt

SEQ ID NO: 139 - DNA, 21 bp, Artificial Sequence
  Description of Combined DNA/RNA Molecule: Synthetic oligonucleotide
  Description of Artificial Sequence: Synthetic oligonucleotide
ggaucguaagaaggcaguutt

SEQ ID NO: 140 - DNA, 21 bp, Artificial Sequence
  Description of Combined DNA/RNA Molecule: Synthetic oligonucleotide
  Description of Artificial Sequence: Synthetic oligonucleotide
aacugccuucuuacgaucctt

SEQ ID NO: 141 - DNA, 21 bp, Artificial Sequence
  Description of Combined DNA/RNA Molecule: Synthetic oligonucleotide
  Description of Artificial Sequence: Synthetic oligonucleotide
aucguaagaaggcaguugatt

SEQ ID NO: 142 - DNA, 21 bp, Artificial Sequence
  Description of Combined DNA/RNA Molecule: Synthetic oligonucleotide
  Description of Artificial Sequence: Synthetic oligonucleotide
ucaacugccuucuuacgautt

SEQ ID NO: 143 - DNA, 21 bp, Artificial Sequence
  Description of Combined DNA/RNA Molecule: Synthetic oligonucleotide
  Description of Artificial Sequence: Synthetic oligonucleotide
aggcaguugaccaacacaatt

SEQ ID NO: 144 - DNA, 21 bp, Artificial Sequence
  Description of Combined DNA/RNA Molecule: Synthetic oligonucleotide
  Description of Artificial Sequence: Synthetic oligonucleotide
uuguguuggucaacugccutt

SEQ ID NO: 145 - DNA, 21 bp, Artificial Sequence
  Description of Combined DNA/RNA Molecule: Synthetic oligonucleotide
  Description of Artificial Sequence: Synthetic oligonucleotide
uggccgauaagauagaagatt

SEQ ID NO: 146 - DNA, 21 bp, Artificial Sequence
  Description of Combined DNA/RNA Molecule: Synthetic oligonucleotide
  Description of Artificial Sequence: Synthetic oligonucleotide
ucuucuaucuuaucggccatt

SEQ ID NO: 147 - DNA, 21 bp, Artificial Sequence
  Description of Combined DNA/RNA Molecule: Synthetic oligonucleotide
  Description of Artificial Sequence: Synthetic oligonucleotide
ucuaaggauauagucaacatt

SEQ ID NO: 148 - DNA, 21 bp, Artificial Sequence
  Description of Combined DNA/RNA Molecule: Synthetic oligonucleotide
  Description of Artificial Sequence: Synthetic oligonucleotide
uguugacuauauccuuagatt

SEQ ID NO: 149 - DNA, 21 bp, Artificial Sequence
  Description of Combined DNA/RNA Molecule: Synthetic oligonucleotide
  Description of Artificial Sequence: Synthetic oligonucleotide
acuaagcuuaauugcuuuctt

SEQ ID NO: 150 - DNA, 21 bp, Artificial Sequence
  Description of Combined DNA/RNA Molecule: Synthetic oligonucleotide
  Description of Artificial Sequence: Synthetic oligonucleotide
gaaagcaauuaagcuuagutt

SEQ ID NO: 151 - DNA, 21 bp, Artificial Sequence
  Description of Combined DNA/RNA Molecule: Synthetic oligonucleotide
  Description of Artificial Sequence: Synthetic oligonucleotide
gcccagaucaaccuuuaautt

SEQ ID NO: 152 - DNA, 21 bp, Artificial Sequence
  Description of Combined DNA/RNA Molecule: Synthetic oligonucleotide
  Description of Artificial Sequence: Synthetic oligonucleotide
auuaaagguugaucugggctt

SEQ ID NO: 153 - DNA, 21 bp, Artificial Sequence
  Description of Combined DNA/RNA Molecule: Synthetic oligonucleotide
  Description of Artificial Sequence: Synthetic oligonucleotide
uuaauuuggcagagcggaatt

SEQ ID NO: 154 - DNA, 21 bp, Artificial Sequence
  Description of Combined DNA/RNA Molecule: Synthetic oligonucleotide
  Description of Artificial Sequence: Synthetic oligonucleotide
uuccgcucugccaaauuaatt

SEQ ID NO: 155 - DNA, 21 bp, Artificial Sequence
  Description of Combined DNA/RNA Molecule: Synthetic oligonucleotide
  Description of Artificial Sequence: Synthetic oligonucleotide
uuaucgagaaucuaaacuatt

SEQ ID NO: 156 - DNA, 21 bp, Artificial Sequence
  Description of Combined DNA/RNA Molecule: Synthetic oligonucleotide
  Description of Artificial Sequence: Synthetic oligonucleotide
uaguuuagauucucgauaatt

SEQ ID NO: 157 - DNA, 21 bp, Artificial Sequence
  Description of Combined DNA/RNA Molecule: Synthetic oligonucleotide
  Description of Artificial Sequence: Synthetic oligonucleotide
cuagcgcccauucaauagutt

SEQ ID NO: 158 - DNA, 21 bp, Artificial Sequence
  Description of Combined DNA/RNA Molecule: Synthetic oligonucleotide
  Description of Artificial Sequence: Synthetic oligonucleotide
acuauugaaugggcgcuagtt

SEQ ID NO: 159 - DNA, 21 bp, Artificial Sequence
  Description of Combined DNA/RNA Molecule: Synthetic oligonucleotide
  Description of Artificial Sequence: Synthetic oligonucleotide
aauaguagaaugugauccutt

SEQ ID NO: 160 - DNA, 21 bp, Artificial Sequence
  Description of Combined DNA/RNA Molecule: Synthetic oligonucleotide
  Description of Artificial Sequence: Synthetic oligonucleotide
aggaucacauucuacuauutt

SEQ ID NO: 161 - DNA, 21 bp, Artificial Sequence
  Description of Combined DNA/RNA Molecule: Synthetic oligonucleotide
  Description of Artificial Sequence: Synthetic oligonucleotide
uacgaaaagaaguuagugutt

SEQ ID NO: 162 - DNA, 21 bp, Artificial Sequence
  Description of Combined DNA/RNA Molecule: Synthetic oligonucleotide
  Description of Artificial Sequence: Synthetic oligonucleotide
acacuaacuucuuuucguatt

SEQ ID NO: 163 - DNA, 21 bp, Artificial Sequence
  Description of Combined DNA/RNA Molecule: Synthetic oligonucleotide
  Description of Artificial Sequence: Synthetic oligonucleotide
agaaguuaguguacgaacutt

SEQ ID NO: 164 - DNA, 21 bp, Artificial Sequence
  Description of Combined DNA/RNA Molecule: Synthetic oligonucleotide
  Description of Artificial Sequence: Synthetic oligonucleotide
aguucguacacuaacuucutt

SEQ ID NO: 165 - DNA, 21 bp, Artificial Sequence
  Description of Combined DNA/RNA Molecule: Synthetic oligonucleotide
  Description of Artificial Sequence: Synthetic oligonucleotide
acuaaacagauugauguuutt

SEQ ID NO: 166 - DNA, 21 bp, Artificial Sequence
  Description of Combined DNA/RNA Molecule: Synthetic oligonucleotide
  Description of Artificial Sequence: Synthetic oligonucleotide
aaacaucaaucuguuuagutt

SEQ ID NO: 167 - DNA, 21 bp, Artificial Sequence
  Description of Combined DNA/RNA Molecule: Synthetic oligonucleotide
  Description of Artificial Sequence: Synthetic oligonucleotide
cuuugcguauggccaaacutt

SEQ ID NO: 168 - DNA, 21 bp, Artificial Sequence
  Description of Combined DNA/RNA Molecule: Synthetic oligonucleotide
  Description of Artificial Sequence: Synthetic oligonucleotide
aguuuggccauacgcaaagtt

SEQ ID NO: 169 - DNA, 21 bp, Artificial Sequence
  Description of Combined DNA/RNA Molecule: Synthetic oligonucleotide
  Description of Artificial Sequence: Synthetic oligonucleotide
aaugaagaguauaccugggtt

SEQ ID NO: 170 - DNA, 21 bp, Artificial Sequence
  Description of Combined DNA/RNA Molecule: Synthetic oligonucleotide
  Description of Artificial Sequence: Synthetic oligonucleotide
cccagguauacucuucauutt

SEQ ID NO: 171 - DNA, 21 bp, Artificial Sequence
  Description of Combined DNA/RNA Molecule: Synthetic oligonucleotide
  Description of Artificial Sequence: Synthetic oligonucleotide
auaauuccacguacccuuctt

SEQ ID NO: 172 - DNA, 21 bp, Artificial Sequence
  Description of Combined DNA/RNA Molecule: Synthetic oligonucleotide
  Description of Artificial Sequence: Synthetic oligonucleotide
gaaggguacguggaauuautt

SEQ ID NO: 173 - DNA, 21 bp, Artificial Sequence
  Description of Combined DNA/RNA Molecule: Synthetic oligonucleotide
  Description of Artificial Sequence: Synthetic oligonucleotide
acguacccuucaucaaauutt

SEQ ID NO: 174 - DNA, 21 bp, Artificial Sequence
  Description of Combined DNA/RNA Molecule: Synthetic oligonucleotide
  Description of Artificial Sequence: Synthetic oligonucleotide
aauuugaugaaggguacgutt

SEQ ID NO: 175 - DNA, 21 bp, Artificial Sequence
  Description of Combined DNA/RNA Molecule: Synthetic oligonucleotide
  Description of Artificial Sequence: Synthetic oligonucleotide
cguacccuucaucaaauuutt

SEQ ID NO: 176 - DNA, 21 bp, Artificial Sequence
  Description of Combined DNA/RNA Molecule: Synthetic oligonucleotide
  Description of Artificial Sequence: Synthetic oligonucleotide
aaauuugaugaaggguacgtt

SEQ ID NO: 177 - DNA, 21 bp, Artificial Sequence
  Description of Combined DNA/RNA Molecule: Synthetic oligonucleotide
  Description of Artificial Sequence: Synthetic oligonucleotide
guacccuucaucaaauuuutt

SEQ ID NO: 178 - DNA, 21 bp, Artificial Sequence
  Description of Combined DNA/RNA Molecule: Synthetic oligonucleotide
  Description of Artificial Sequence: Synthetic oligonucleotide
aaaauuugaugaaggguactt

SEQ ID NO: 179 - DNA, 21 bp, Artificial Sequence
  Description of Combined DNA/RNA Molecule: Synthetic oligonucleotide
  Description of Artificial Sequence: Synthetic oligonucleotide
aacuuacugauaaugguactt

SEQ ID NO: 180 - DNA, 21 bp, Artificial Sequence
  Description of Combined DNA/RNA Molecule: Synthetic oligonucleotide
  Description of Artificial Sequence: Synthetic oligonucleotide
guaccauuaucaguaaguutt

SEQ ID NO: 181 - DNA, 21 bp, Artificial Sequence
  Description of Combined DNA/RNA Molecule: Synthetic oligonucleotide
  Description of Artificial Sequence: Synthetic oligonucleotide
uucagucaaagugucucugtt

SEQ ID NO: 182 - DNA, 21 bp, Artificial Sequence
  Description of Combined DNA/RNA Molecule: Synthetic oligonucleotide
  Description of Artificial Sequence: Synthetic oligonucleotide
cagagacacuuugacugaatt

SEQ ID NO: 183 - DNA, 21 bp, Artificial Sequence
  Description of Combined DNA/RNA Molecule: Synthetic oligonucleotide
  Description of Artificial Sequence: Synthetic oligonucleotide
uucuuaauccaucaucugatt

SEQ ID NO: 184 - DNA, 21 bp, Artificial Sequence
  Description of Combined DNA/RNA Molecule: Synthetic oligonucleotide
  Description of Artificial Sequence: Synthetic oligonucleotide
ucagaugauggauuaagaatt

SEQ ID NO: 185 - DNA, 21 bp, Artificial Sequence
  Description of Combined DNA/RNA Molecule: Synthetic oligonucleotide
  Description of Artificial Sequence: Synthetic oligonucleotide
acaguacacaacaaggaugtt

SEQ ID NO: 186 - DNA, 21 bp, Artificial Sequence
  Description of Combined DNA/RNA Molecule: Synthetic oligonucleotide
  Description of Artificial Sequence: Synthetic oligonucleotide
cauccuuguuguguacugutt

SEQ ID NO: 187 - DNA, 21 bp, Artificial Sequence
  Description of Combined DNA/RNA Molecule: Synthetic oligonucleotide
  Description of Artificial Sequence: Synthetic oligonucleotide
aagaaacuacgauugauggtt

SEQ ID NO: 188 - DNA, 21 bp, Artificial Sequence
  Description of Combined DNA/RNA Molecule: Synthetic oligonucleotide
  Description of Artificial Sequence: Synthetic oligonucleotide
ccaucaaucguaguuucuutt

SEQ ID NO: 189 - DNA, 21 bp, Artificial Sequence
  Description of Combined DNA/RNA Molecule: Synthetic oligonucleotide
  Description of Artificial Sequence: Synthetic oligonucleotide
aaacuacgauugauggagatt

SEQ ID NO: 190 - DNA, 21 bp, Artificial Sequence
  Description of Combined DNA/RNA Molecule: Synthetic oligonucleotide
  Description of Artificial Sequence: Synthetic oligonucleotide
ucuccaucaaucguaguuutt

SEQ ID NO: 191 - DNA, 21 bp, Artificial Sequence
  Description of Combined DNA/RNA Molecule: Synthetic oligonucleotide
  Description of Artificial Sequence: Synthetic oligonucleotide
uggagcuguugauaagagatt

SEQ ID NO: 192 - DNA, 21 bp, Artificial Sequence
  Description of Combined DNA/RNA Molecule: Synthetic oligonucleotide
  Description of Artificial Sequence: Synthetic oligonucleotide
ucucuuaucaacagcuccatt

SEQ ID NO: 193 - DNA, 21 bp, Artificial Sequence
  Description of Combined DNA/RNA Molecule: Synthetic oligonucleotide
  Description of Artificial Sequence: Synthetic oligonucleotide
cuaacuagaauccuccaggtt

SEQ ID NO: 194 - DNA, 21 bp, Artificial Sequence
  Description of Combined DNA/RNA Molecule: Synthetic oligonucleotide
  Description of Artificial Sequence: Synthetic oligonucleotide
ccuggaggauucuaguuagtt

SEQ ID NO: 195 - DNA, 21 bp, Artificial Sequence
  Description of Combined DNA/RNA Molecule: Synthetic oligonucleotide
  Description of Artificial Sequence: Synthetic oligonucleotide
gaauaugcucauagagcaatt

SEQ ID NO: 196 - DNA, 21 bp, Artificial Sequence
  Description of Combined DNA/RNA Molecule: Synthetic oligonucleotide
  Description of Artificial Sequence: Synthetic oligonucleotide
uugcucuaugagcauauuctt

SEQ ID NO: 197 - DNA, 21 bp, Artificial Sequence
  Description of Combined DNA/RNA Molecule: Synthetic oligonucleotide
  Description of Artificial Sequence: Synthetic oligonucleotide
augcucauagagcaaagaatt

SEQ ID NO: 198 - DNA, 21 bp, Artificial Sequence
  Description of Combined DNA/RNA Molecule: Synthetic oligonucleotide
  Description of Artificial Sequence: Synthetic oligonucleotide
uucuuugcucuaugagcautt

SEQ ID NO: 199 - DNA, 21 bp, Artificial Sequence
  Description of Combined DNA/RNA Molecule: Synthetic oligonucleotide
  Description of Artificial Sequence: Synthetic oligonucleotide
aaaaauuggugcuguugagtt

SEQ ID NO: 200 - DNA, 21 bp, Artificial Sequence
  Description of Combined DNA/RNA Molecule: Synthetic oligonucleotide
  Description of Artificial Sequence: Synthetic oligonucleotide
cucaacagcaccaauuuuutt

SEQ ID NO: 201 - DNA, 21 bp, Artificial Sequence
  Description of Combined DNA/RNA Molecule: Synthetic oligonucleotide
  Description of Artificial Sequence: Synthetic oligonucleotide
gaggagcugaauaggguuatt

SEQ ID NO: 202 - DNA, 21 bp, Artificial Sequence
  Description of Combined DNA/RNA Molecule: Synthetic oligonucleotide
  Description of Artificial Sequence: Synthetic oligonucleotide
uaacccuauucagcuccuctt

SEQ ID NO: 203 - DNA, 21 bp, Artificial Sequence
  Description of Combined DNA/RNA Molecule: Synthetic oligonucleotide
  Description of Artificial Sequence: Synthetic oligonucleotide
ggagcugaauaggguuacatt

SEQ ID NO: 204 - DNA, 21 bp, Artificial Sequence
  Description of Combined DNA/RNA Molecule: Synthetic oligonucleotide
  Description of Artificial Sequence: Synthetic oligonucleotide
uguaacccuauucagcucctt

SEQ ID NO: 205 - DNA, 21 bp, Artificial Sequence
  Description of Combined DNA/RNA Molecule: Synthetic oligonucleotide
  Description of Artificial Sequence: Synthetic oligonucleotide
gagcugaauaggguuacagtt

SEQ ID NO: 206 - DNA, 21 bp, Artificial Sequence
  Description of Combined DNA/RNA Molecule: Synthetic oligonucleotide
  Description of Artificial Sequence: Synthetic oligonucleotide
cuguaacccuauucagcuctt

SEQ ID NO: 207 - DNA, 21 bp, Artificial Sequence
  Description of Combined DNA/RNA Molecule: Synthetic oligonucleotide
  Description of Artificial Sequence: Synthetic oligonucleotide
agcugaauaggguuacagatt

SEQ ID NO: 208 - DNA, 21 bp, Artificial Sequence
  Description of Combined DNA/RNA Molecule: Synthetic oligonucleotide
  Description of Artificial Sequence: Synthetic oligonucleotide
ucuguaacccuauucagcutt

SEQ ID NO: 209 - DNA, 21 bp, Artificial Sequence
  Description of Combined DNA/RNA Molecule: Synthetic oligonucleotide
  Description of Artificial Sequence: Synthetic oligonucleotide
gcugaauaggguuacagagtt

SEQ ID NO: 210 - DNA, 21 bp, Artificial Sequence
  Description of Combined DNA/RNA Molecule: Synthetic oligonucleotide
  Description of Artificial Sequence: Synthetic oligonucleotide
cucuguaacccuauucagctt

SEQ ID NO: 211 - DNA, 21 bp, Artificial Sequence
  Description of Combined DNA/RNA Molecule: Synthetic oligonucleotide
  Description of Artificial Sequence: Synthetic oligonucleotide
ccaaacuggaucguaagaatt

SEQ ID NO: 212 - DNA, 21 bp, Artificial Sequence
  Description of Combined DNA/RNA Molecule: Synthetic oligonucleotide
  Description of Artificial Sequence: Synthetic oligonucleotide
uucuuacgauccaguuuggtt

SEQ ID NO: 213 - DNA, 21 bp, Artificial Sequence
  Description of Combined DNA/RNA Molecule: Synthetic oligonucleotide
  Description of Artificial Sequence: Synthetic oligonucleotide
gaucguaagaaggcaguugtt

SEQ ID NO: 214 - DNA, 21 bp, Artificial Sequence
  Description of Combined DNA/RNA Molecule: Synthetic oligonucleotide
  Description of Artificial Sequence: Synthetic oligonucleotide
caacugccuucuuacgauctt

SEQ ID NO: 215 - DNA, 21 bp, Artificial Sequence
  Description of Combined DNA/RNA Molecule: Synthetic oligonucleotide
  Description of Artificial Sequence: Synthetic oligonucleotide
accuuauuugguaaucugctt

SEQ ID NO: 216 - DNA, 21 bp, Artificial Sequence
  Description of Combined DNA/RNA Molecule: Synthetic oligonucleotide
  Description of Artificial Sequence: Synthetic oligonucleotide
gcagauuaccaaauaaggutt

SEQ ID NO: 217 - DNA, 21 bp, Artificial Sequence
  Description of Combined DNA/RNA Molecule: Synthetic oligonucleotide
  Description of Artificial Sequence: Synthetic oligonucleotide
uuagauaccauuacuacagtt

SEQ ID NO: 218 - DNA, 21 bp, Artificial Sequence
  Description of Combined DNA/RNA Molecule: Synthetic oligonucleotide
  Description of Artificial Sequence: Synthetic oligonucleotide
cuguaguaaugguaucuaatt

SEQ ID NO: 219 - DNA, 21 bp, Artificial Sequence
  Description of Combined DNA/RNA Molecule: Synthetic oligonucleotide
  Description of Artificial Sequence: Synthetic oligonucleotide
auaccauuacuacaguagctt

SEQ ID NO: 220 - DNA, 21 bp, Artificial Sequence
  Description of Combined DNA/RNA Molecule: Synthetic oligonucleotide
  Description of Artificial Sequence: Synthetic oligonucleotide
gcuacuguaguaaugguautt

SEQ ID NO: 221 - DNA, 21 bp, Artificial Sequence
  Description of Combined DNA/RNA Molecule: Synthetic oligonucleotide
  Description of Artificial Sequence: Synthetic oligonucleotide
uacuacaguagcacuuggatt

SEQ ID NO: 222 - DNA, 21 bp, Artificial Sequence
  Description of Combined DNA/RNA Molecule: Synthetic oligonucleotide
  Description of Artificial Sequence: Synthetic oligonucleotide
uccaagugcuacuguaguatt

SEQ ID NO: 223 - DNA, 21 bp, Artificial Sequence
  Description of Combined DNA/RNA Molecule: Synthetic oligonucleotide
  Description of Artificial Sequence: Synthetic oligonucleotide
aaaguaaaacuguacuacatt

SEQ ID NO: 224 - DNA, 21 bp, Artificial Sequence
  Description of Combined DNA/RNA Molecule: Synthetic oligonucleotide
  Description of Artificial Sequence: Synthetic oligonucleotide
uguaguacaguuuuacuuutt

SEQ ID NO: 225 - DNA, 21 bp, Artificial Sequence
  Description of Combined DNA/RNA Molecule: Synthetic oligonucleotide
  Description of Artificial Sequence: Synthetic oligonucleotide
cucaagacugaucuucuaatt

SEQ ID NO: 226 - DNA, 21 bp, Artificial Sequence
  Description of Combined DNA/RNA Molecule: Synthetic oligonucleotide
  Description of Artificial Sequence: Synthetic oligonucleotide
uuagaagaucagucuugagtt

SEQ ID NO: 227 - DNA, 21 bp, Artificial Sequence
  Description of Combined DNA/RNA Molecule: Synthetic oligonucleotide
  Description of Artificial Sequence: Synthetic oligonucleotide
uugacaguggccgauaagatt

SEQ ID NO: 228 - DNA, 21 bp, Artificial Sequence
  Description of Combined DNA/RNA Molecule: Synthetic oligonucleotide
  Description of Artificial Sequence: Synthetic oligonucleotide
ucuuaucggccacugucaatt

SEQ ID NO: 229 - DNA, 21 bp, Artificial Sequence
  Description of Combined DNA/RNA Molecule: Synthetic oligonucleotide
  Description of Artificial Sequence: Synthetic oligonucleotide
ugacaguggccgauaagautt

SEQ ID NO: 230 - DNA, 21 bp, Artificial Sequence
  Description of Combined DNA/RNA Molecule: Synthetic oligonucleotide
  Description of Artificial Sequence: Synthetic oligonucleotide
aucuuaucggccacugucatt

SEQ ID NO: 231 - DNA, 21 bp, Artificial Sequence
  Description of Combined DNA/RNA Molecule: Synthetic oligonucleotide
  Description of Artificial Sequence: Synthetic oligonucleotide
gcaauguggaaaccuaacutt

SEQ ID NO: 232 - DNA, 21 bp, Artificial Sequence
  Description of Combined DNA/RNA Molecule: Synthetic oligonucleotide
  Description of Artificial Sequence: Synthetic oligonucleotide
aguuagguuuccacauugctt

SEQ ID NO: 233 - DNA, 21 bp, Artificial Sequence
  Description of Combined DNA/RNA Molecule: Synthetic oligonucleotide
  Description of Artificial Sequence: Synthetic oligonucleotide
ccacuuaguaguguccaggtt

SEQ ID NO: 234 - DNA, 21 bp, Artificial Sequence
  Description of Combined DNA/RNA Molecule: Synthetic oligonucleotide
  Description of Artificial Sequence: Synthetic oligonucleotide
ccuggacacuacuaaguggtt

SEQ ID NO: 235 - DNA, 21 bp, Artificial Sequence
  Description of Combined DNA/RNA Molecule: Synthetic oligonucleotide
  Description of Artificial Sequence: Synthetic oligonucleotide
agaagguacaaaauugguutt

SEQ ID NO: 236 - DNA, 21 bp, Artificial Sequence
  Description of Combined DNA/RNA Molecule: Synthetic oligonucleotide
  Description of Artificial Sequence: Synthetic oligonucleotide
aaccaauuuuguaccuucutt

SEQ ID NO: 237 - DNA, 21 bp, Artificial Sequence
  Description of Combined DNA/RNA Molecule: Synthetic oligonucleotide
  Description of Artificial Sequence: Synthetic oligonucleotide
ugguuugacuaagcuuaautt

SEQ ID NO: 238 - DNA, 21 bp, Artificial Sequence
  Description of Combined DNA/RNA Molecule: Synthetic oligonucleotide
  Description of Artificial Sequence: Synthetic oligonucleotide
auuaagcuuagucaaaccatt

SEQ ID NO: 239 - DNA, 21 bp, Artificial Sequence
  Description of Combined DNA/RNA Molecule: Synthetic oligonucleotide
  Description of Artificial Sequence: Synthetic oligonucleotide
gguuugacuaagcuuaauutt

SEQ ID NO: 240 - DNA, 21 bp, Artificial Sequence
  Description of Combined DNA/RNA Molecule: Synthetic oligonucleotide
  Description of Artificial Sequence: Synthetic oligonucleotide
aauuaagcuuagucaaacctt

SEQ ID NO: 241 - DNA, 21 bp, Artificial Sequence
  Description of Combined DNA/RNA Molecule: Synthetic oligonucleotide
  Description of Artificial Sequence: Synthetic oligonucleotide
ucuaagucaagagccaucutt

SEQ ID NO: 242 - DNA, 21 bp, Artificial Sequence
  Description of Combined DNA/RNA Molecule: Synthetic oligonucleotide
  Description of Artificial Sequence: Synthetic oligonucleotide
agauggcucuugacuuagatt

SEQ ID NO: 243 - DNA, 21 bp, Artificial Sequence
  Description of Combined DNA/RNA Molecule: Synthetic oligonucleotide
  Description of Artificial Sequence: Synthetic oligonucleotide
ucaucccuauaguucacuutt

SEQ ID NO: 244 - DNA, 21 bp, Artificial Sequence
  Description of Combined DNA/RNA Molecule: Synthetic oligonucleotide
  Description of Artificial Sequence: Synthetic oligonucleotide
aagugaacuauagggaugatt

SEQ ID NO: 245 - DNA, 21 bp, Artificial Sequence
  Description of Combined DNA/RNA Molecule: Synthetic oligonucleotide
  Description of Artificial Sequence: Synthetic oligonucleotide
caucccuauaguucacuuutt

SEQ ID NO: 246 - DNA, 21 bp, Artificial Sequence
  Description of Combined DNA/RNA Molecule: Synthetic oligonucleotide
  Description of Artificial Sequence: Synthetic oligonucleotide
aaagugaacuauagggaugtt

SEQ ID NO: 247 - DNA, 21 bp, Artificial Sequence
  Description of Combined DNA/RNA Molecule: Synthetic oligonucleotide
  Description of Artificial Sequence: Synthetic oligonucleotide
cccuagacuucccuauuuctt

SEQ ID NO: 248 - DNA, 21 bp, Artificial Sequence
  Description of Combined DNA/RNA Molecule: Synthetic oligonucleotide
  Description of Artificial Sequence: Synthetic oligonucleotide
gaaauagggaagucuagggtt

SEQ ID NO: 249 - DNA, 21 bp, Artificial Sequence
  Description of Combined DNA/RNA Molecule: Synthetic oligonucleotide
  Description of Artificial Sequence: Synthetic oligonucleotide
agacuucccuauuucgcuutt

SEQ ID NO: 250 - DNA, 21 bp, Artificial Sequence
  Description of Combined DNA/RNA Molecule: Synthetic oligonucleotide
  Description of Artificial Sequence: Synthetic oligonucleotide
aagcgaaauagggaagucutt

SEQ ID NO: 251 - DNA, 21 bp, Artificial Sequence
  Description of Combined DNA/RNA Molecule: Synthetic oligonucleotide
  Description of Artificial Sequence: Synthetic oligonucleotide
ucaccaaaccauuuguagatt

SEQ ID NO: 252 - DNA, 21 bp, Artificial Sequence
  Description of Combined DNA/RNA Molecule: Synthetic oligonucleotide
  Description of Artificial Sequence: Synthetic oligonucleotide
ucuacaaaugguuuggugatt

SEQ ID NO: 253 - DNA, 21 bp, Artificial Sequence
  Description of Combined DNA/RNA Molecule: Synthetic oligonucleotide
  Description of Artificial Sequence: Synthetic oligonucleotide
uccuuuaagaggccuaacutt

SEQ ID NO: 254 - DNA, 21 bp, Artificial Sequence
  Description of Combined DNA/RNA Molecule: Synthetic oligonucleotide
  Description of Artificial Sequence: Synthetic oligonucleotide
aguuaggccucuuaaaggatt

SEQ ID NO: 255 - DNA, 21 bp, Artificial Sequence
  Description of Combined DNA/RNA Molecule: Synthetic oligonucleotide
  Description of Artificial Sequence: Synthetic oligonucleotide
uuuaagaggccuaacucautt

SEQ ID NO: 256 - DNA, 21 bp, Artificial Sequence
  Description of Combined DNA/RNA Molecule: Synthetic oligonucleotide
  Description of Artificial Sequence: Synthetic oligonucleotide
augaguuaggccucuuaaatt

SEQ ID NO: 257 - DNA, 21 bp, Artificial Sequence
  Description of Combined DNA/RNA Molecule: Synthetic oligonucleotide
  Description of Artificial Sequence: Synthetic oligonucleotide
uuaagaggccuaacucauutt

SEQ ID NO: 258 - DNA, 21 bp, Artificial Sequence
  Description of Combined DNA/RNA Molecule: Synthetic oligonucleotide
  Description of Artificial Sequence: Synthetic oligonucleotide
aaugaguuaggccucuuaatt

SEQ ID NO: 259 - DNA, 21 bp, Artificial Sequence
  Description of Combined DNA/RNA Molecule: Synthetic oligonucleotide
  Description of Artificial Sequence: Synthetic oligonucleotide
ggccuaacucauucacccutt

SEQ ID NO: 260 - DNA, 21 bp, Artificial Sequence
  Description of Combined DNA/RNA Molecule: Synthetic oligonucleotide
  Description of Artificial Sequence: Synthetic oligonucleotide
agggugaaugaguuaggcctt

SEQ ID NO: 261 - DNA, 21 bp, Artificial Sequence
  Description of Combined DNA/RNA Molecule: Synthetic oligonucleotide
  Description of Artificial Sequence: Synthetic oligonucleotide
ugguauuuuugaucuggcatt

SEQ ID NO: 262 - DNA, 21 bp, Artificial Sequence
  Description of Combined DNA/RNA Molecule: Synthetic oligonucleotide
  Description of Artificial Sequence: Synthetic oligonucleotide
ugccagaucaaaaauaccatt

SEQ ID NO: 263 - DNA, 21 bp, Artificial Sequence
  Description of Combined DNA/RNA Molecule: Synthetic oligonucleotide
  Description of Artificial Sequence: Synthetic oligonucleotide
aguuuaguguguaaaguuutt

SEQ ID NO: 264 - DNA, 21 bp, Artificial Sequence
  Description of Combined DNA/RNA Molecule: Synthetic oligonucleotide
  Description of Artificial Sequence: Synthetic oligonucleotide
aaacuuuacacacuaaacutt

SEQ ID NO: 265 - DNA, 21 bp, Artificial Sequence
  Description of Combined DNA/RNA Molecule: Synthetic oligonucleotide
  Description of Artificial Sequence: Synthetic oligonucleotide
gccaaauucgucugcgaagtt

SEQ ID NO: 266 - DNA, 21 bp, Artificial Sequence
  Description of Combined DNA/RNA Molecule: Synthetic oligonucleotide
  Description of Artificial Sequence: Synthetic oligonucleotide
cuucgcagacgaauuuggctt

SEQ ID NO: 267 - DNA, 21 bp, Artificial Sequence
  Description of Combined DNA/RNA Molecule: Synthetic oligonucleotide
  Description of Artificial Sequence: Synthetic oligonucleotide
aauucgucugcgaagaagatt

SEQ ID NO: 268 - DNA, 21 bp, Artificial Sequence
  Description of Combined DNA/RNA Molecule: Synthetic oligonucleotide
  Description of Artificial Sequence: Synthetic oligonucleotide
ucuucuucgcagacgaauutt

SEQ ID NO: 269 - DNA, 21 bp, Artificial Sequence
  Description of Combined DNA/RNA Molecule: Synthetic oligonucleotide
  Description of Artificial Sequence: Synthetic oligonucleotide
ugaaaggucaccuaaugaatt

SEQ ID NO: 270 - DNA, 21 bp, Artificial Sequence
  Description of Combined DNA/RNA Molecule: Synthetic oligonucleotide
  Description of Artificial Sequence: Synthetic oligonucleotide
uucauuaggugaccuuucatt

SEQ ID NO: 271 - DNA, 21 bp, Artificial Sequence
  Description of Combined DNA/RNA Molecule: Synthetic oligonucleotide
  Description of Artificial Sequence: Synthetic oligonucleotide
cagaccauuuaauuuggcatt

SEQ ID NO: 272 - DNA, 21 bp, Artificial Sequence
  Description of Combined DNA/RNA Molecule: Synthetic oligonucleotide
  Description of Artificial Sequence: Synthetic oligonucleotide
ugccaaauuaaauggucugtt

SEQ ID NO: 273 - DNA, 21 bp, Artificial Sequence
  Description of Combined DNA/RNA Molecule: Synthetic oligonucleotide
  Description of Artificial Sequence: Synthetic oligonucleotide
agaccauuuaauuuggcagtt

SEQ ID NO: 274 - DNA, 21 bp, Artificial Sequence
  Description of Combined DNA/RNA Molecule: Synthetic oligonucleotide
  Description of Artificial Sequence: Synthetic oligonucleotide
cugccaaauuaaauggucutt

SEQ ID NO: 275 - DNA, 21 bp, Artificial Sequence
  Description of Combined DNA/RNA Molecule: Synthetic oligonucleotide
  Description of Artificial Sequence: Synthetic oligonucleotide
aguuauuaugggcuauaautt

SEQ ID NO: 276 - DNA, 21 bp, Artificial Sequence
  Description of Combined DNA/RNA Molecule: Synthetic oligonucleotide
  Description of Artificial Sequence: Synthetic oligonucleotide
auuauagcccauaauaacutt

SEQ ID NO: 277 - DNA, 21 bp, Artificial Sequence
  Description of Combined DNA/RNA Molecule: Synthetic oligonucleotide
  Description of Artificial Sequence: Synthetic oligonucleotide
gcugguauaauuccacguatt

SEQ ID NO: 278 - DNA, 21 bp, Artificial Sequence
  Description of Combined DNA/RNA Molecule: Synthetic oligonucleotide
  Description of Artificial Sequence: Synthetic oligonucleotide
uacguggaauuauaccagctt

SEQ ID NO: 279 - DNA, 21 bp, Artificial Sequence
  Description of Combined DNA/RNA Molecule: Synthetic oligonucleotide
  Description of Artificial Sequence: Synthetic oligonucleotide
auuuaauuuggcagagcggtt

SEQ ID NO: 280 - DNA, 21 bp, Artificial Sequence
  Description of Combined DNA/RNA Molecule: Synthetic oligonucleotide
  Description of Artificial Sequence: Synthetic oligonucleotide
ccgcucugccaaauuaaautt

SEQ ID NO: 281 - DNA, 21 bp, Artificial Sequence
  Description of Combined DNA/RNA Molecule: Synthetic oligonucleotide
  Description of Artificial Sequence: Synthetic oligonucleotide
uuuaauuuggcagagcggatt

SEQ ID NO: 282 - DNA, 21 bp, Artificial Sequence
  Description of Combined DNA/RNA Molecule: Synthetic oligonucleotide
  Description of Artificial Sequence: Synthetic oligonucleotide
uccgcucugccaaauuaaatt

SEQ ID NO: 283 - DNA, 21 bp, Artificial Sequence
  Description of Combined DNA/RNA Molecule: Synthetic oligonucleotide
  Description of Artificial Sequence: Synthetic oligonucleotide
uuuggcagagcggaaagcutt

SEQ ID NO: 284 - DNA, 21 bp, Artificial Sequence
  Description of Combined DNA/RNA Molecule: Synthetic oligonucleotide
  Description of Artificial Sequence: Synthetic oligonucleotide
agcuuuccgcucugccaaatt

SEQ ID NO: 285 - DNA, 21 bp, Artificial Sequence
  Description of Combined DNA/RNA Molecule: Synthetic oligonucleotide
  Description of Artificial Sequence: Synthetic oligonucleotide
uuuuacaauggaaggugaatt

SEQ ID NO: 286 - DNA, 21 bp, Artificial Sequence
  Description of Combined DNA/RNA Molecule: Synthetic oligonucleotide
  Description of Artificial Sequence: Synthetic oligonucleotide
uucaccuuccauuguaaaatt

SEQ ID NO: 287 - DNA, 21 bp, Artificial Sequence
  Description of Combined DNA/RNA Molecule: Synthetic oligonucleotide
  Description of Artificial Sequence: Synthetic oligonucleotide
aauggaaggugaaaggucatt

SEQ ID NO: 288 - DNA, 21 bp, Artificial Sequence
  Description of Combined DNA/RNA Molecule: Synthetic oligonucleotide
  Description of Artificial Sequence: Synthetic oligonucleotide
ugaccuuucaccuuccauutt

SEQ ID NO: 289 - DNA, 21 bp, Artificial Sequence
  Description of Combined DNA/RNA Molecule: Synthetic oligonucleotide
  Description of Artificial Sequence: Synthetic oligonucleotide
ugagaugcagaccauuuaatt

SEQ ID NO: 290 - DNA, 21 bp, Artificial Sequence
  Description of Combined DNA/RNA Molecule: Synthetic oligonucleotide
  Description of Artificial Sequence: Synthetic oligonucleotide
uuaaauggucugcaucucatt

SEQ ID NO: 291 - DNA, 21 bp, Artificial Sequence
  Description of Combined DNA/RNA Molecule: Synthetic oligonucleotide
  Description of Artificial Sequence: Synthetic oligonucleotide
ucgcagccaaauucgucugtt

SEQ ID NO: 292 - DNA, 21 bp, Artificial Sequence
  Description of Combined DNA/RNA Molecule: Synthetic oligonucleotide
  Description of Artificial Sequence: Synthetic oligonucleotide
cagacgaauuuggcugcgatt

SEQ ID NO: 293 - DNA, 21 bp, Artificial Sequence
  Description of Combined DNA/RNA Molecule: Synthetic oligonucleotide
  Description of Artificial Sequence: Synthetic oligonucleotide
ggcuauaauugcacuaucutt

SEQ ID NO: 294 - DNA, 21 bp, Artificial Sequence
  Description of Combined DNA/RNA Molecule: Synthetic oligonucleotide
  Description of Artificial Sequence: Synthetic oligonucleotide
agauagugcaauuauagcctt

SEQ ID NO: 295 - DNA, 21 bp, Artificial Sequence
  Description of Combined DNA/RNA Molecule: Synthetic oligonucleotide
  Description of Artificial Sequence: Synthetic oligonucleotide
auugacaguggccgauaagtt

SEQ ID NO: 296 - DNA, 21 bp, Artificial Sequence
  Description of Combined DNA/RNA Molecule: Synthetic oligonucleotide
  Description of Artificial Sequence: Synthetic oligonucleotide
cuuaucggccacugucaautt

SEQ ID NO: 297 - DNA, 21 bp, Artificial Sequence
  Description of Combined DNA/RNA Molecule: Synthetic oligonucleotide
  Description of Artificial Sequence: Synthetic oligonucleotide
cuagacuucccuauuucgctt

SEQ ID NO: 298 - DNA, 21 bp, Artificial Sequence
  Description of Combined DNA/RNA Molecule: Synthetic oligonucleotide
  Description of Artificial Sequence: Synthetic oligonucleotide
gcgaaauagggaagucuagtt

SEQ ID NO: 299 - DNA, 21 bp, Artificial Sequence
  Description of Combined DNA/RNA Molecule: Synthetic oligonucleotide
  Description of Artificial Sequence: Synthetic oligonucleotide
acuaucuuugcguauggcctt

SEQ ID NO: 300 - DNA, 21 bp, Artificial Sequence
  Description of Combined DNA/RNA Molecule: Synthetic oligonucleotide
  Description of Artificial Sequence: Synthetic oligonucleotide
ggccauacgcaaagauagutt

SEQ ID NO: 301 - DNA, 21 bp, Artificial Sequence
  Description of Combined DNA/RNA Molecule: Synthetic oligonucleotide
  Description of Artificial Sequence: Synthetic oligonucleotide
auacucuagucguucccactt

SEQ ID NO: 302 - DNA, 21 bp, Artificial Sequence
  Description of Combined DNA/RNA Molecule: Synthetic oligonucleotide
  Description of Artificial Sequence: Synthetic oligonucleotide
gugggaacgacuagaguautt

SEQ ID NO: 303 - DNA, 21 bp, Artificial Sequence
  Description of Combined DNA/RNA Molecule: Synthetic oligonucleotide
  Description of Artificial Sequence: Synthetic oligonucleotide
aaagaaacuacgauugaugtt

SEQ ID NO: 304 - DNA, 21 bp, Artificial Sequence
  Description of Combined DNA/RNA Molecule: Synthetic oligonucleotide
  Description of Artificial Sequence: Synthetic oligonucleotide
caucaaucguaguuucuuutt

SEQ ID NO: 305 - DNA, 21 bp, Artificial Sequence
  Description of Combined DNA/RNA Molecule: Synthetic oligonucleotide
  Description of Artificial Sequence: Synthetic oligonucleotide
gccuugauuuuuuggcgggtt

SEQ ID NO: 306 - DNA, 21 bp, Artificial Sequence
  Description of Combined DNA/RNA Molecule: Synthetic oligonucleotide
  Description of Artificial Sequence: Synthetic oligonucleotide
cccgccaaaaaaucaaggctt

SEQ ID NO: 307 - DNA, 21 bp, Artificial Sequence
  Description of Combined DNA/RNA Molecule: Synthetic oligonucleotide
  Description of Artificial Sequence: Synthetic oligonucleotide
cgcccauucaauaguagaatt

SEQ ID NO: 308 - DNA, 21 bp, Artificial Sequence
  Description of Combined DNA/RNA Molecule: Synthetic oligonucleotide
  Description of Artificial Sequence: Synthetic oligonucleotide
uucuacuauugaaugggcgtt

SEQ ID NO: 309 - DNA, 21 bp, Artificial Sequence
  Description of Combined DNA/RNA Molecule: Synthetic oligonucleotide
  Description of Artificial Sequence: Synthetic oligonucleotide
ccuuauuugguaaucugcutt

SEQ ID NO: 310 - DNA, 21 bp, Artificial Sequence
  Description of Combined DNA/RNA Molecule: Synthetic oligonucleotide
  Description of Artificial Sequence: Synthetic oligonucleotide
agcagauuaccaaauaaggtt

SEQ ID NO: 311 - DNA, 21 bp, Artificial Sequence
  Description of Combined DNA/RNA Molecule: Synthetic oligonucleotide
  Description of Artificial Sequence: Synthetic oligonucleotide
agagacaauuccggaugugtt

SEQ ID NO: 312 - DNA, 21 bp, Artificial Sequence
  Description of Combined DNA/RNA Molecule: Synthetic oligonucleotide
  Description of Artificial Sequence: Synthetic oligonucleotide
cacauccggaauugucucutt

SEQ ID NO: 313 - DNA, 21 bp, Artificial Sequence
  Description of Combined DNA/RNA Molecule: Synthetic oligonucleotide
  Description of Artificial Sequence: Synthetic oligonucleotide
ugacuuugauagcuaaauutt

SEQ ID NO: 314 - DNA, 21 bp, Artificial Sequence
  Description of Combined DNA/RNA Molecule: Synthetic oligonucleotide
  Description of Artificial Sequence: Synthetic oligonucleotide
aauuuagcuaucaaagucatt

SEQ ID NO: 315 - DNA, 21 bp, Artificial Sequence
  Description of Combined DNA/RNA Molecule: Synthetic oligonucleotide
  Description of Artificial Sequence: Synthetic oligonucleotide
uggcagagcggaaagcuagtt

SEQ ID NO: 316 - DNA, 21 bp, Artificial Sequence
  Description of Combined DNA/RNA Molecule: Synthetic oligonucleotide
  Description of Artificial Sequence: Synthetic oligonucleotide
cuagcuuuccgcucugccatt

SEQ ID NO: 317 - DNA, 21 bp, Artificial Sequence
  Description of Combined DNA/RNA Molecule: Synthetic oligonucleotide
  Description of Artificial Sequence: Synthetic oligonucleotide
gagcggaaagcuagcgccctt

SEQ ID NO: 318 - DNA, 21 bp, Artificial Sequence
  Description of Combined DNA/RNA Molecule: Synthetic oligonucleotide
  Description of Artificial Sequence: Synthetic oligonucleotide
gggcgcuagcuuuccgcuctt

SEQ ID NO: 319 - DNA, 21 bp, Artificial Sequence
  Description of Combined DNA/RNA Molecule: Synthetic oligonucleotide
  Description of Artificial Sequence: Synthetic oligonucleotide
aaagaaguuaguguacgaatt

SEQ ID NO: 320 - DNA, 21 bp, Artificial Sequence
  Description of Combined DNA/RNA Molecule: Synthetic oligonucleotide
  Description of Artificial Sequence: Synthetic oligonucleotide
uucguacacuaacuucuuutt

SEQ ID NO: 321 - DNA, 21 bp, Artificial Sequence
  Description of Combined DNA/RNA Molecule: Synthetic oligonucleotide
  Description of Artificial Sequence: Synthetic oligonucleotide
auugcacuaucuuugcguatt

SEQ ID NO: 322 - DNA, 21 bp, Artificial Sequence
  Description of Combined DNA/RNA Molecule: Synthetic oligonucleotide
  Description of Artificial Sequence: Synthetic oligonucleotide
uacgcaaagauagugcaautt

SEQ ID NO: 323 - DNA, 21 bp, Artificial Sequence
  Description of Combined DNA/RNA Molecule: Synthetic oligonucleotide
  Description of Artificial Sequence: Synthetic oligonucleotide
gguauaauuccacguaccctt

SEQ ID NO: 324 - DNA, 21 bp, Artificial Sequence
  Description of Combined DNA/RNA Molecule: Synthetic oligonucleotide
  Description of Artificial Sequence: Synthetic oligonucleotide
ggguacguggaauuauacctt

SEQ ID NO: 325 - DNA, 21 bp, Artificial Sequence
  Description of Combined DNA/RNA Molecule: Synthetic oligonucleotide
  Description of Artificial Sequence: Synthetic oligonucleotide
uacucuagucguucccacutt

SEQ ID NO: 326 - DNA, 21 bp, Artificial Sequence
  Description of Combined DNA/RNA Molecule: Synthetic oligonucleotide
  Description of Artificial Sequence: Synthetic oligonucleotide
agugggaacgacuagaguatt

SEQ ID NO: 327 - DNA, 21 bp, Artificial Sequence
  Description of Combined DNA/RNA Molecule: Synthetic oligonucleotide
  Description of Artificial Sequence: Synthetic oligonucleotide
uaugaaagaaacuacgauutt

SEQ ID NO: 328 - DNA, 21 bp, Artificial Sequence
  Description of Combined DNA/RNA Molecule: Synthetic oligonucleotide
  Description of Artificial Sequence: Synthetic oligonucleotide
aaucguaguuucuuucauatt

SEQ ID NO: 329 - DNA, 21 bp, Artificial Sequence
  Description of Combined DNA/RNA Molecule: Synthetic oligonucleotide
  Description of Artificial Sequence: Synthetic oligonucleotide
augcuagaaguacauaagatt

SEQ ID NO: 330 - DNA, 21 bp, Artificial Sequence
  Description of Combined DNA/RNA Molecule: Synthetic oligonucleotide
  Description of Artificial Sequence: Synthetic oligonucleotide
ucuuauguacuucuagcautt

SEQ ID NO: 331 - DNA, 21 bp, Artificial Sequence
  Description of Combined DNA/RNA Molecule: Synthetic oligonucleotide
  Description of Artificial Sequence: Synthetic oligonucleotide
aaguacauaagaccuuauutt

SEQ ID NO: 332 - DNA, 21 bp, Artificial Sequence
  Description of Combined DNA/RNA Molecule: Synthetic oligonucleotide
  Description of Artificial Sequence: Synthetic oligonucleotide
aauaaggucuuauguacuutt

SEQ ID NO: 333 - DNA, 21 bp, Artificial Sequence
  Description of Combined DNA/RNA Molecule: Synthetic oligonucleotide
  Description of Artificial Sequence: Synthetic oligonucleotide
acagccugagcuguuaaugtt

SEQ ID NO: 334 - DNA, 21 bp, Artificial Sequence
  Description of Combined DNA/RNA Molecule: Synthetic oligonucleotide
  Description of Artificial Sequence: Synthetic oligonucleotide
cauuaacagcucaggcugutt

SEQ ID NO: 335 - DNA, 21 bp, Artificial Sequence
  Description of Combined DNA/RNA Molecule: Synthetic oligonucleotide
  Description of Artificial Sequence: Synthetic oligonucleotide
aaagaagagacaauuccggtt

SEQ ID NO: 336 - DNA, 21 bp, Artificial Sequence
  Description of Combined DNA/RNA Molecule: Synthetic oligonucleotide
  Description of Artificial Sequence: Synthetic oligonucleotide
ccggaauugucucuucuuutt

SEQ ID NO: 337 - DNA, 21 bp, Artificial Sequence
  Description of Combined DNA/RNA Molecule: Synthetic oligonucleotide
  Description of Artificial Sequence: Synthetic oligonucleotide
cacacuggagaggucuaaatt

SEQ ID NO: 338 - DNA, 21 bp, Artificial Sequence
  Description of Combined DNA/RNA Molecule: Synthetic oligonucleotide
  Description of Artificial Sequence: Synthetic oligonucleotide
uuuagaccucuccagugugtt

SEQ ID NO: 339 - DNA, 21 bp, Artificial Sequence
  Description of Combined DNA/RNA Molecule: Synthetic oligonucleotide
  Description of Artificial Sequence: Synthetic oligonucleotide
cacuggagaggucuaaagutt

SEQ ID NO: 340 - DNA, 21 bp, Artificial Sequence
  Description of Combined DNA/RNA Molecule: Synthetic oligonucleotide
  Description of Artificial Sequence: Synthetic oligonucleotide
acuuuagaccucuccagugtt

SEQ ID NO: 341 - DNA, 21 bp, Artificial Sequence
  Description of Combined DNA/RNA Molecule: Synthetic oligonucleotide
  Description of Artificial Sequence: Synthetic oligonucleotide
acuggagaggucuaaagugtt

SEQ ID NO: 342 - DNA, 21 bp, Artificial Sequence
  Description of Combined DNA/RNA Molecule: Synthetic oligonucleotide
  Description of Artificial Sequence: Synthetic oligonucleotide
cacuuuagaccucuccagutt

SEQ ID NO: 343 - DNA, 21 bp, Artificial Sequence
  Description of Combined DNA/RNA Molecule: Synthetic oligonucleotide
  Description of Artificial Sequence: Synthetic oligonucleotide
cgucgcagccaaauucguctt

SEQ ID NO: 344 - DNA, 21 bp, Artificial Sequence
  Description of Combined DNA/RNA Molecule: Synthetic oligonucleotide
  Description of Artificial Sequence: Synthetic oligonucleotide
gacgaauuuggcugcgacgtt

SEQ ID NO: 345 - DNA, 21 bp, Artificial Sequence
  Description of Combined DNA/RNA Molecule: Synthetic oligonucleotide
  Description of Artificial Sequence: Synthetic oligonucleotide
gaaggcaguugaccaacactt

SEQ ID NO: 346 - DNA, 21 bp, Artificial Sequence
  Description of Combined DNA/RNA Molecule: Synthetic oligonucleotide
  Description of Artificial Sequence: Synthetic oligonucleotide
guguuggucaacugccuuctt

SEQ ID NO: 347 - DNA, 21 bp, Artificial Sequence
  Description of Combined DNA/RNA Molecule: Synthetic oligonucleotide
  Description of Artificial Sequence: Synthetic oligonucleotide
cauucacccugacagaguutt

SEQ ID NO: 348 - DNA, 21 bp, Artificial Sequence
  Description of Combined DNA/RNA Molecule: Synthetic oligonucleotide
  Description of Artificial Sequence: Synthetic oligonucleotide
aacucugucagggugaaugtt

SEQ ID NO: 349 - DNA, 21 bp, Artificial Sequence
  Description of Combined DNA/RNA Molecule: Synthetic oligonucleotide
  Description of Artificial Sequence: Synthetic oligonucleotide
aagaggccuaacucauucatt

SEQ ID NO: 350 - DNA, 21 bp, Artificial Sequence
  Description of Combined DNA/RNA Molecule: Synthetic oligonucleotide
  Description of Artificial Sequence: Synthetic oligonucleotide
ugaaugaguuaggccucuutt

SEQ ID NO: 351 - DNA, 21 bp, Artificial Sequence
  Description of Combined DNA/RNA Molecule: Synthetic oligonucleotide
  Description of Artificial Sequence: Synthetic oligonucleotide
gagacaauuccggauguggtt

SEQ ID NO: 352 - DNA, 21 bp, Artificial Sequence
  Description of Combined DNA/RNA Molecule: Synthetic oligonucleotide
  Description of Artificial Sequence: Synthetic oligonucleotide
ccacauccggaauugucuctt

SEQ ID NO: 353 - DNA, 21 bp, Artificial Sequence
  Description of Combined DNA/RNA Molecule: Synthetic oligonucleotide
  Description of Artificial Sequence: Synthetic oligonucleotide
uuccggauguggauguagatt

SEQ ID NO: 354 - DNA, 21 bp, Artificial Sequence
  Description of Combined DNA/RNA Molecule: Synthetic oligonucleotide
  Description of Artificial Sequence: Synthetic oligonucleotide
ucuacauccacauccggaatt

SEQ ID NO: 355 - DNA, 21 bp, Artificial Sequence
  Description of Combined DNA/RNA Molecule: Synthetic oligonucleotide
  Description of Artificial Sequence: Synthetic oligonucleotide
aagcuagcgcccauucaautt

SEQ ID NO: 356 - DNA, 21 bp, Artificial Sequence
  Description of Combined DNA/RNA Molecule: Synthetic oligonucleotide
  Description of Artificial Sequence: Synthetic oligonucleotide
auugaaugggcgcuagcuutt

SEQ ID NO: 357 - DNA, 21 bp, Artificial Sequence
  Description of Combined DNA/RNA Molecule: Synthetic oligonucleotide
  Description of Artificial Sequence: Synthetic oligonucleotide
gaaguuaguguacgaacugtt

SEQ ID NO: 358 - DNA, 21 bp, Artificial Sequence
  Description of Combined DNA/RNA Molecule: Synthetic oligonucleotide
  Description of Artificial Sequence: Synthetic oligonucleotide
caguucguacacuaacuuctt

SEQ ID NO: 359 - DNA, 21 bp, Artificial Sequence
  Description of Combined DNA/RNA Molecule: Synthetic oligonucleotide
  Description of Artificial Sequence: Synthetic oligonucleotide
uauaauuccacguacccuutt

SEQ ID NO: 360 - DNA, 21 bp, Artificial Sequence
  Description of Combined DNA/RNA Molecule: Synthetic oligonucleotide
  Description of Artificial Sequence: Synthetic oligonucleotide
aaggguacguggaauuauatt

SEQ ID NO: 361 - DNA, 21 bp, Artificial Sequence
  Description of Combined DNA/RNA Molecule: Synthetic oligonucleotide
  Description of Artificial Sequence: Synthetic oligonucleotide
acaguggccgauaagauagtt

SEQ ID NO: 362 - DNA, 21 bp, Artificial Sequence
  Description of Combined DNA/RNA Molecule: Synthetic oligonucleotide
  Description of Artificial Sequence: Synthetic oligonucleotide
cuaucuuaucggccacugutt

SEQ ID NO: 363 - DNA, 21 bp, Artificial Sequence
  Description of Combined DNA/RNA Molecule: Synthetic oligonucleotide
  Description of Artificial Sequence: Synthetic oligonucleotide
ucugucaucccuauaguuctt

SEQ ID NO: 364 - DNA, 21 bp, Artificial Sequence
  Description of Combined DNA/RNA Molecule: Synthetic oligonucleotide
  Description of Artificial Sequence: Synthetic oligonucleotide
gaacuauagggaugacagatt

SEQ ID NO: 365 - DNA, 21 bp, Artificial Sequence
  Description of Combined DNA/RNA Molecule: Synthetic oligonucleotide
  Description of Artificial Sequence: Synthetic oligonucleotide
uucuugcuaugacuugugutt

SEQ ID NO: 366 - DNA, 21 bp, Artificial Sequence
  Description of Combined DNA/RNA Molecule: Synthetic oligonucleotide
  Description of Artificial Sequence: Synthetic oligonucleotide
acacaagucauagcaagaatt

SEQ ID NO: 367 - DNA, 21 bp, Artificial Sequence
  Description of Combined DNA/RNA Molecule: Synthetic oligonucleotide
  Description of Artificial Sequence: Synthetic oligonucleotide
guaagaaggcaguugaccatt

SEQ ID NO: 368 - DNA, 21 bp, Artificial Sequence
  Description of Combined DNA/RNA Molecule: Synthetic oligonucleotide
  Description of Artificial Sequence: Synthetic oligonucleotide
uggucaacugccuucuuactt

SEQ ID NO: 369 - DNA, 21 bp, Artificial Sequence
  Description of Combined DNA/RNA Molecule: Synthetic oligonucleotide
  Description of Artificial Sequence: Synthetic oligonucleotide
cauugacaguggccgauaatt

SEQ ID NO: 370 - DNA, 21 bp, Artificial Sequence
  Description of Combined DNA/RNA Molecule: Synthetic oligonucleotide
  Description of Artificial Sequence: Synthetic oligonucleotide
uuaucggccacugucaaugtt

SEQ ID NO: 371 - DNA, 21 bp, Artificial Sequence
  Description of Combined DNA/RNA Molecule: Synthetic oligonucleotide
  Description of Artificial Sequence: Synthetic oligonucleotide
agaaaccacuuaguagugutt

SEQ ID NO: 372 - DNA, 21 bp, Artificial Sequence
  Description of Combined DNA/RNA Molecule: Synthetic oligonucleotide
  Description of Artificial Sequence: Synthetic oligonucleotide
acacuacuaagugguuucutt

SEQ ID NO: 373 - DNA, 21 bp, Artificial Sequence
  Description of Combined DNA/RNA Molecule: Synthetic oligonucleotide
  Description of Artificial Sequence: Synthetic oligonucleotide
ggauuguucaucaauuggctt

SEQ ID NO: 374 - DNA, 21 bp, Artificial Sequence
  Description of Combined DNA/RNA Molecule: Synthetic oligonucleotide
  Description of Artificial Sequence: Synthetic oligonucleotide
gccaauugaugaacaaucctt

SEQ ID NO: 375 - DNA, 21 bp, Artificial Sequence
  Description of Combined DNA/RNA Molecule: Synthetic oligonucleotide
  Description of Artificial Sequence: Synthetic oligonucleotide
uaagaggccuaacucauuctt

SEQ ID NO: 376 - DNA, 21 bp, Artificial Sequence
  Description of Combined DNA/RNA Molecule: Synthetic oligonucleotide
  Description of Artificial Sequence: Synthetic oligonucleotide
gaaugaguuaggccucuuatt

SEQ ID NO: 377 - DNA, 21 bp, Artificial Sequence
  Description of Combined DNA/RNA Molecule: Synthetic oligonucleotide
  Description of Artificial Sequence: Synthetic oligonucleotide
aguuaguguacgaacuggatt

SEQ ID NO: 378 - DNA, 21 bp, Artificial Sequence
  Description of Combined DNA/RNA Molecule: Synthetic oligonucleotide
  Description of Artificial Sequence: Synthetic oligonucleotide
uccaguucguacacuaacutt

SEQ ID NO: 379 - DNA, 21 bp, Artificial Sequence
  Description of Combined DNA/RNA Molecule: Synthetic oligonucleotide
  Description of Artificial Sequence: Synthetic oligonucleotide
aguacauaagaccuuauuutt

SEQ ID NO: 380 - DNA, 21 bp, Artificial Sequence
  Description of Combined DNA/RNA Molecule: Synthetic oligonucleotide
  Description of Artificial Sequence: Synthetic oligonucleotide
aaauaaggucuuauguacutt

SEQ ID NO: 381 - DNA, 21 bp, Artificial Sequence
  Description of Combined DNA/RNA Molecule: Synthetic oligonucleotide
  Description of Artificial Sequence: Synthetic oligonucleotide
ugagccuuguguauagauutt

SEQ ID NO: 382 - DNA, 21 bp, Artificial Sequence
  Description of Combined DNA/RNA Molecule: Synthetic oligonucleotide
  Description of Artificial Sequence: Synthetic oligonucleotide
aaucuauacacaaggcucatt

SEQ ID NO: 383 - DNA, 21 bp, Artificial Sequence
  Description of Combined DNA/RNA Molecule: Synthetic oligonucleotide
  Description of Artificial Sequence: Synthetic oligonucleotide
ccuuuaagaggccuaacuctt

SEQ ID NO: 384 - DNA, 21 bp, Artificial Sequence
  Description of Combined DNA/RNA Molecule: Synthetic oligonucleotide
  Description of Artificial Sequence: Synthetic oligonucleotide
gaguuaggccucuuaaaggtt

SEQ ID NO: 385 - DNA, 21 bp, Artificial Sequence
  Description of Combined DNA/RNA Molecule: Synthetic oligonucleotide
  Description of Artificial Sequence: Synthetic oligonucleotide
accacuuaguaguguccagtt

SEQ ID NO: 386 - DNA, 21 bp, Artificial Sequence
  Description of Combined DNA/RNA Molecule: Synthetic oligonucleotide
  Description of Artificial Sequence: Synthetic oligonucleotide
cuggacacuacuaaguggutt

SEQ ID NO: 387 - DNA, 21 bp, Artificial Sequence
  Description of Combined DNA/RNA Molecule: Synthetic oligonucleotide
  Description of Artificial Sequence: Synthetic oligonucleotide
gaaacuuccaauuaugucutt

SEQ ID NO: 388 - DNA, 21 bp, Artificial Sequence
  Description of Combined DNA/RNA Molecule: Synthetic oligonucleotide
  Description of Artificial Sequence: Synthetic oligonucleotide
agacauaauuggaaguuuctt

SEQ ID NO: 389 - DNA, 21 bp, Artificial Sequence
  Description of Combined DNA/RNA Molecule: Synthetic oligonucleotide
  Description of Artificial Sequence: Synthetic oligonucleotide
ugcauacucuagucguucctt

SEQ ID NO: 390 - DNA, 21 bp, Artificial Sequence
  Description of Combined DNA/RNA Molecule: Synthetic oligonucleotide
  Description of Artificial Sequence: Synthetic oligonucleotide
ggaacgacuagaguaugcatt

SEQ ID NO: 391 - DNA, 21 bp, Artificial Sequence
  Description of Combined DNA/RNA Molecule: Synthetic oligonucleotide
  Description of Artificial Sequence: Synthetic oligonucleotide
agaaggcaguugaccaacatt

SEQ ID NO: 392 - DNA, 21 bp, Artificial Sequence
  Description of Combined DNA/RNA Molecule: Synthetic oligonucleotide
  Description of Artificial Sequence: Synthetic oligonucleotide
uguuggucaacugccuucutt

SEQ ID NO: 393 - DNA, 21 bp, Artificial Sequence
  Description of Combined DNA/RNA Molecule: Synthetic oligonucleotide
  Description of Artificial Sequence: Synthetic oligonucleotide
guacauaagaccuuauuugtt

SEQ ID NO: 394 - DNA, 21 bp, Artificial Sequence
  Description of Combined DNA/RNA Molecule: Synthetic oligonucleotide
  Description of Artificial Sequence: Synthetic oligonucleotide
caaauaaggucuuauguactt

SEQ ID NO: 395 - DNA, 21 bp, Artificial Sequence
  Description of Combined DNA/RNA Molecule: Synthetic oligonucleotide
  Description of Artificial Sequence: Synthetic oligonucleotide
uauaauugcacuaucuuugtt

SEQ ID NO: 396 - DNA, 21 bp, Artificial Sequence
  Description of Combined DNA/RNA Molecule: Synthetic oligonucleotide
  Description of Artificial Sequence: Synthetic oligonucleotide
caaagauagugcaauuauatt

SEQ ID NO: 397 - DNA, 21 bp, Artificial Sequence
  Description of Combined DNA/RNA Molecule: Synthetic oligonucleotide
  Description of Artificial Sequence: Synthetic oligonucleotide
ucucuguuacaauacauautt

SEQ ID NO: 398 - DNA, 21 bp, Artificial Sequence
  Description of Combined DNA/RNA Molecule: Synthetic oligonucleotide
  Description of Artificial Sequence: Synthetic oligonucleotide
auauguauuguaacagagatt

SEQ ID NO: 399 - DNA, 21 bp, Artificial Sequence
  Description of Combined DNA/RNA Molecule: Synthetic oligonucleotide
  Description of Artificial Sequence: Synthetic oligonucleotide
uaugcucauagagcaaagatt

SEQ ID NO: 400 - DNA, 21 bp, Artificial Sequence
  Description of Combined DNA/RNA Molecule: Synthetic oligonucleotide
  Description of Artificial Sequence: Synthetic oligonucleotide
ucuuugcucuaugagcauatt

SEQ ID NO: 401 - DNA, 21 bp, Artificial Sequence
  Description of Combined DNA/RNA Molecule: Synthetic oligonucleotide
  Description of Artificial Sequence: Synthetic oligonucleotide
uguuguuuguccaauucugtt

SEQ ID NO: 402 - DNA, 21 bp, Artificial Sequence
  Description of Combined DNA/RNA Molecule: Synthetic oligonucleotide
  Description of Artificial Sequence: Synthetic oligonucleotide
cagaauuggacaaacaacatt

SEQ ID NO: 403 - DNA, 21 bp, Artificial Sequence
  Description of Combined DNA/RNA Molecule: Synthetic oligonucleotide
  Description of Artificial Sequence: Synthetic oligonucleotide
acuaacuagaauccuccagtt

SEQ ID NO: 404 - DNA, 21 bp, Artificial Sequence
  Description of Combined DNA/RNA Molecule: Synthetic oligonucleotide
  Description of Artificial Sequence: Synthetic oligonucleotide
cuggaggauucuaguuagutt

SEQ ID NO: 405 - DNA, 21 bp, Artificial Sequence
  Description of Combined DNA/RNA Molecule: Synthetic oligonucleotide
  Description of Artificial Sequence: Synthetic oligonucleotide
uguggugucuauacugaaatt

SEQ ID NO: 406 - DNA, 21 bp, Artificial Sequence
  Description of Combined DNA/RNA Molecule: Synthetic oligonucleotide
  Description of Artificial Sequence: Synthetic oligonucleotide
uuucaguauagacaccacatt

SEQ ID NO: 407 - DNA, 21 bp, Artificial Sequence
  Description of Combined DNA/RNA Molecule: Synthetic oligonucleotide
  Description of Artificial Sequence: Synthetic oligonucleotide
uauuaugggagaccacccatt

SEQ ID NO: 408 - DNA, 21 bp, Artificial Sequence
  Description of Combined DNA/RNA Molecule: Synthetic oligonucleotide
  Description of Artificial Sequence: Synthetic oligonucleotide
uggguggucucccauaauatt

SEQ ID NO: 409 - DNA, 21 bp, Artificial Sequence
  Description of Combined DNA/RNA Molecule: Synthetic oligonucleotide
  Description of Artificial Sequence: Synthetic oligonucleotide
aaggaugaagucuaucaaatt

SEQ ID NO: 410 - DNA, 21 bp, Artificial Sequence
  Description of Combined DNA/RNA Molecule: Synthetic oligonucleotide
  Description of Artificial Sequence: Synthetic oligonucleotide
uuugauagacuucauccuutt

SEQ ID NO: 411 - DNA, 21 bp, Artificial Sequence
  Description of Combined DNA/RNA Molecule: Synthetic oligonucleotide
  Description of Artificial Sequence: Synthetic oligonucleotide
uugauaagagagcucgggatt

SEQ ID NO: 412 - DNA, 21 bp, Artificial Sequence
  Description of Combined DNA/RNA Molecule: Synthetic oligonucleotide
  Description of Artificial Sequence: Synthetic oligonucleotide
ucccgagcucucuuaucaatt

SEQ ID NO: 413 - DNA, 21 bp, Artificial Sequence
  Description of Combined DNA/RNA Molecule: Synthetic oligonucleotide
  Description of Artificial Sequence: Synthetic oligonucleotide
auguuccuuaucgagaauctt

SEQ ID NO: 414 - DNA, 21 bp, Artificial Sequence
  Description of Combined DNA/RNA Molecule: Synthetic oligonucleotide
  Description of Artificial Sequence: Synthetic oligonucleotide
gauucucgauaaggaacautt

SEQ ID NO: 415 - DNA, 21 bp, Artificial Sequence
  Description of Combined DNA/RNA Molecule: Synthetic oligonucleotide
  Description of Artificial Sequence: Synthetic oligonucleotide
ggaauaugcucauagagcatt

SEQ ID NO: 416 - DNA, 21 bp, Artificial Sequence
  Description of Combined DNA/RNA Molecule: Synthetic oligonucleotide
  Description of Artificial Sequence: Synthetic oligonucleotide
ugcucuaugagcauauucctt

SEQ ID NO: 417 - DNA, 21 bp, Artificial Sequence
  Description of Combined DNA/RNA Molecule: Synthetic oligonucleotide
  Description of Artificial Sequence: Synthetic oligonucleotide
ccauuccaaacuggaucgutt

SEQ ID NO: 418 - DNA, 21 bp, Artificial Sequence
  Description of Combined DNA/RNA Molecule: Synthetic oligonucleotide
  Description of Artificial Sequence: Synthetic oligonucleotide
acgauccaguuuggaauggtt

SEQ ID NO: 419 - DNA, 21 bp, Artificial Sequence
  Description of Combined DNA/RNA Molecule: Synthetic oligonucleotide
  Description of Artificial Sequence: Synthetic oligonucleotide
ggcaguugaccaacacaautt

SEQ ID NO: 420 - DNA, 21 bp, Artificial Sequence
  Description of Combined DNA/RNA Molecule: Synthetic oligonucleotide
  Description of Artificial Sequence: Synthetic oligonucleotide
auuguguuggucaacugcctt

SEQ ID NO: 421 - DNA, 21 bp, Artificial Sequence
  Description of Combined DNA/RNA Molecule: Synthetic oligonucleotide
  Description of Artificial Sequence: Synthetic oligonucleotide
caugcuagaaguacauaagtt

SEQ ID NO: 422 - DNA, 21 bp, Artificial Sequence
  Description of Combined DNA/RNA Molecule: Synthetic oligonucleotide
  Description of Artificial Sequence: Synthetic oligonucleotide
cuuauguacuucuagcaugtt

SEQ ID NO: 423 - DNA, 21 bp, Artificial Sequence
  Description of Combined DNA/RNA Molecule: Synthetic oligonucleotide
  Description of Artificial Sequence: Synthetic oligonucleotide
cuagaaguacauaagaccutt

SEQ ID NO: 424 - DNA, 21 bp, Artificial Sequence
  Description of Combined DNA/RNA Molecule: Synthetic oligonucleotide
  Description of Artificial Sequence: Synthetic oligonucleotide
aggucuuauguacuucuagtt

SEQ ID NO: 425 - DNA, 21 bp, Artificial Sequence
  Description of Combined DNA/RNA Molecule: Synthetic oligonucleotide
  Description of Artificial Sequence: Synthetic oligonucleotide
uuggaucucucacaucuautt

SEQ ID NO: 426 - DNA, 21 bp, Artificial Sequence
  Description of Combined DNA/RNA Molecule: Synthetic oligonucleotide
  Description of Artificial Sequence: Synthetic oligonucleotide
auagaugugagagauccaatt

SEQ ID NO: 427 - DNA, 21 bp, Artificial Sequence
  Description of Combined DNA/RNA Molecule: Synthetic oligonucleotide
  Description of Artificial Sequence: Synthetic oligonucleotide
aacuguggugucuauacugtt

SEQ ID NO: 428 - DNA, 21 bp, Artificial Sequence
  Description of Combined DNA/RNA Molecule: Synthetic oligonucleotide
  Description of Artificial Sequence: Synthetic oligonucleotide
caguauagacaccacaguutt

SEQ ID NO: 429 - DNA, 21 bp, Artificial Sequence
  Description of Combined DNA/RNA Molecule: Synthetic oligonucleotide
  Description of Artificial Sequence: Synthetic oligonucleotide
ucauugacaguggccgauatt

SEQ ID NO: 430 - DNA, 21 bp, Artificial Sequence
  Description of Combined DNA/RNA Molecule: Synthetic oligonucleotide
  Description of Artificial Sequence: Synthetic oligonucleotide
uaucggccacugucaaugatt

SEQ ID NO: 431 - DNA, 21 bp, Artificial Sequence
  Description of Combined DNA/RNA Molecule: Synthetic oligonucleotide
  Description of Artificial Sequence: Synthetic oligonucleotide
auaaagcagacccauuccctt

SEQ ID NO: 432 - DNA, 21 bp, Artificial Sequence
  Description of Combined DNA/RNA Molecule: Synthetic oligonucleotide
  Description of Artificial Sequence: Synthetic oligonucleotide
gggaaugggucugcuuuautt

SEQ ID NO: 433 - DNA, 21 bp, Artificial Sequence
  Description of Combined DNA/RNA Molecule: Synthetic oligonucleotide
  Description of Artificial Sequence: Synthetic oligonucleotide
acagaaaccacuuaguagutt

SEQ ID NO: 434 - DNA, 21 bp, Artificial Sequence
  Description of Combined DNA/RNA Molecule: Synthetic oligonucleotide
  Description of Artificial Sequence: Synthetic oligonucleotide
acuacuaagugguuucugutt

SEQ ID NO: 435 - DNA, 21 bp, Artificial Sequence
  Description of Combined DNA/RNA Molecule: Synthetic oligonucleotide
  Description of Artificial Sequence: Synthetic oligonucleotide
gaaaccacuuaguaguguctt

SEQ ID NO: 436 - DNA, 21 bp, Artificial Sequence
  Description of Combined DNA/RNA Molecule: Synthetic oligonucleotide
  Description of Artificial Sequence: Synthetic oligonucleotide
gacacuacuaagugguuuctt

SEQ ID NO: 437 - DNA, 21 bp, Artificial Sequence
  Description of Combined DNA/RNA Molecule: Synthetic oligonucleotide
  Description of Artificial Sequence: Synthetic oligonucleotide
aaaucuaaggauauagucatt

SEQ ID NO: 438 - DNA, 21 bp, Artificial Sequence
  Description of Combined DNA/RNA Molecule: Synthetic oligonucleotide
  Description of Artificial Sequence: Synthetic oligonucleotide
ugacuauauccuuagauuutt

SEQ ID NO: 439 - DNA, 21 bp, Artificial Sequence
  Description of Combined DNA/RNA Molecule: Synthetic oligonucleotide
  Description of Artificial Sequence: Synthetic oligonucleotide
uuauuuauacccaucaacatt

SEQ ID NO: 440 - DNA, 21 bp, Artificial Sequence
  Description of Combined DNA/RNA Molecule: Synthetic oligonucleotide
  Description of Artificial Sequence: Synthetic oligonucleotide
uguugauggguauaaauaatt

SEQ ID NO: 441 - DNA, 21 bp, Artificial Sequence
  Description of Combined DNA/RNA Molecule: Synthetic oligonucleotide
  Description of Artificial Sequence: Synthetic oligonucleotide
acagaggcauuaacacacutt

SEQ ID NO: 442 - DNA, 21 bp, Artificial Sequence
  Description of Combined DNA/RNA Molecule: Synthetic oligonucleotide
  Description of Artificial Sequence: Synthetic oligonucleotide
aguguguuaaugccucugutt

SEQ ID NO: 443 - DNA, 21 bp, Artificial Sequence
  Description of Combined DNA/RNA Molecule: Synthetic oligonucleotide
  Description of Artificial Sequence: Synthetic oligonucleotide
acacacuggagaggucuaatt

SEQ ID NO: 444 - DNA, 21 bp, Artificial Sequence
  Description of Combined DNA/RNA Molecule: Synthetic oligonucleotide
  Description of Artificial Sequence: Synthetic oligonucleotide
uuagaccucuccagugugutt

SEQ ID NO: 445 - DNA, 21 bp, Artificial Sequence
  Description of Combined DNA/RNA Molecule: Synthetic oligonucleotide
  Description of Artificial Sequence: Synthetic oligonucleotide
acacuggagaggucuaaagtt

SEQ ID NO: 446 - DNA, 21 bp, Artificial Sequence
  Description of Combined DNA/RNA Molecule: Synthetic oligonucleotide
  Description of Artificial Sequence: Synthetic oligonucleotide
cuuuagaccucuccagugutt

SEQ ID NO: 447 - DNA, 21 bp, Artificial Sequence
  Description of Combined DNA/RNA Molecule: Synthetic oligonucleotide
  Description of Artificial Sequence: Synthetic oligonucleotide
cgagcccagaucaaccuuutt

SEQ ID NO: 448 - DNA, 21 bp, Artificial Sequence
  Description of Combined DNA/RNA Molecule: Synthetic oligonucleotide
  Description of Artificial Sequence: Synthetic oligonucleotide
aaagguugaucugggcucgtt

SEQ ID NO: 449 - DNA, 21 bp, Artificial Sequence
  Description of Combined DNA/RNA Molecule: Synthetic oligonucleotide
  Description of Artificial Sequence: Synthetic oligonucleotide
ucccuauuucgcuuucucctt

SEQ ID NO: 450 - DNA, 21 bp, Artificial Sequence
  Description of Combined DNA/RNA Molecule: Synthetic oligonucleotide
  Description of Artificial Sequence: Synthetic oligonucleotide
ggagaaagcgaaauagggatt

SEQ ID NO: 451 - DNA, 21 bp, Artificial Sequence
  Description of Combined DNA/RNA Molecule: Synthetic oligonucleotide
  Description of Artificial Sequence: Synthetic oligonucleotide
ucuaaaaucacugucaacatt

SEQ ID NO: 452 - DNA, 21 bp, Artificial Sequence
  Description of Combined DNA/RNA Molecule: Synthetic oligonucleotide
  Description of Artificial Sequence: Synthetic oligonucleotide
uguugacagugauuuuagatt

SEQ ID NO: 453 - DNA, 21 bp, Artificial Sequence
  Description of Combined DNA/RNA Molecule: Synthetic oligonucleotide
  Description of Artificial Sequence: Synthetic oligonucleotide
agccaaauucgucugcgaatt

SEQ ID NO: 454 - DNA, 21 bp, Artificial Sequence
  Description of Combined DNA/RNA Molecule: Synthetic oligonucleotide
  Description of Artificial Sequence: Synthetic oligonucleotide
uucgcagacgaauuuggcutt

SEQ ID NO: 455 - DNA, 21 bp, Artificial Sequence
  Description of Combined DNA/RNA Molecule: Synthetic oligonucleotide
  Description of Artificial Sequence: Synthetic oligonucleotide
cccauucaauaguagaaugtt

SEQ ID NO: 456 - DNA, 21 bp, Artificial Sequence
  Description of Combined DNA/RNA Molecule: Synthetic oligonucleotide
  Description of Artificial Sequence: Synthetic oligonucleotide
cauucuacuauugaaugggtt

SEQ ID NO: 457 - DNA, 21 bp, Artificial Sequence
  Description of Combined DNA/RNA Molecule: Synthetic oligonucleotide
  Description of Artificial Sequence: Synthetic oligonucleotide
gaugaaugcauacucuagutt

SEQ ID NO: 458 - DNA, 21 bp, Artificial Sequence
  Description of Combined DNA/RNA Molecule: Synthetic oligonucleotide
  Description of Artificial Sequence: Synthetic oligonucleotide
acuagaguaugcauucauctt

SEQ ID NO: 459 - DNA, 21 bp, Artificial Sequence
  Description of Combined DNA/RNA Molecule: Synthetic oligonucleotide
  Description of Artificial Sequence: Synthetic oligonucleotide
cucauguuccuuaucgagatt

SEQ ID NO: 460 - DNA, 21 bp, Artificial Sequence
  Description of Combined DNA/RNA Molecule: Synthetic oligonucleotide
  Description of Artificial Sequence: Synthetic oligonucleotide
ucucgauaaggaacaugagtt

SEQ ID NO: 461 - DNA, 21 bp, Artificial Sequence
  Description of Combined DNA/RNA Molecule: Synthetic oligonucleotide
  Description of Artificial Sequence: Synthetic oligonucleotide
gagaaucuaaacuaacuagtt

SEQ ID NO: 462 - DNA, 21 bp, Artificial Sequence
  Description of Combined DNA/RNA Molecule: Synthetic oligonucleotide
  Description of Artificial Sequence: Synthetic oligonucleotide
cuaguuaguuuagauucuctt

SEQ ID NO: 463 - DNA, 21 bp, Artificial Sequence
  Description of Combined DNA/RNA Molecule: Synthetic oligonucleotide
  Description of Artificial Sequence: Synthetic oligonucleotide
uagaaguacauaagaccuutt

SEQ ID NO: 464 - DNA, 21 bp, Artificial Sequence
  Description of Combined DNA/RNA Molecule: Synthetic oligonucleotide
  Description of Artificial Sequence: Synthetic oligonucleotide
aaggucuuauguacuucuatt

SEQ ID NO: 465 - DNA, 21 bp, Artificial Sequence
  Description of Combined DNA/RNA Molecule: Synthetic oligonucleotide
  Description of Artificial Sequence: Synthetic oligonucleotide
cagccugagcuguuaaugatt

SEQ ID NO: 466 - DNA, 21 bp, Artificial Sequence
  Description of Combined DNA/RNA Molecule: Synthetic oligonucleotide
  Description of Artificial Sequence: Synthetic oligonucleotide
ucauuaacagcucaggcugtt

SEQ ID NO: 467 - DNA, 21 bp, Artificial Sequence
  Description of Combined DNA/RNA Molecule: Synthetic oligonucleotide
  Description of Artificial Sequence: Synthetic oligonucleotide
aagaagagacaauuccggatt

SEQ ID NO: 468 - DNA, 21 bp, Artificial Sequence
  Description of Combined DNA/RNA Molecule: Synthetic oligonucleotide
  Description of Artificial Sequence: Synthetic oligonucleotide
uccggaauugucucuucuutt

SEQ ID NO: 469 - DNA, 21 bp, Artificial Sequence
  Description of Combined DNA/RNA Molecule: Synthetic oligonucleotide
  Description of Artificial Sequence: Synthetic oligonucleotide
ugcugguguggauuguucatt

SEQ ID NO: 470 - DNA, 21 bp, Artificial Sequence
  Description of Combined DNA/RNA Molecule: Synthetic oligonucleotide
  Description of Artificial Sequence: Synthetic oligonucleotide
ugaacaauccacaccagcatt

SEQ ID NO: 471 - DNA, 21 bp, Artificial Sequence
  Description of Combined DNA/RNA Molecule: Synthetic oligonucleotide
  Description of Artificial Sequence: Synthetic oligonucleotide
aaauucgucugcgaagaagtt

SEQ ID NO: 472 - DNA, 21 bp, Artificial Sequence
  Description of Combined DNA/RNA Molecule: Synthetic oligonucleotide
  Description of Artificial Sequence: Synthetic oligonucleotide
cuucuucgcagacgaauuutt

SEQ ID NO: 473 - DNA, 21 bp, Artificial Sequence
  Description of Combined DNA/RNA Molecule: Synthetic oligonucleotide
  Description of Artificial Sequence: Synthetic oligonucleotide
uuucuggaaguugagaugutt

SEQ ID NO: 474 - DNA, 21 bp, Artificial Sequence
  Description of Combined DNA/RNA Molecule: Synthetic oligonucleotide
  Description of Artificial Sequence: Synthetic oligonucleotide
acaucucaacuuccagaaatt

SEQ ID NO: 475 - DNA, 21 bp, Artificial Sequence
  Description of Combined DNA/RNA Molecule: Synthetic oligonucleotide
  Description of Artificial Sequence: Synthetic oligonucleotide
uacuaaacagauugauguutt

SEQ ID NO: 476 - DNA, 21 bp, Artificial Sequence
  Description of Combined DNA/RNA Molecule: Synthetic oligonucleotide
  Description of Artificial Sequence: Synthetic oligonucleotide
aacaucaaucuguuuaguatt

SEQ ID NO: 477 - DNA, 21 bp, Artificial Sequence
  Description of Combined DNA/RNA Molecule: Synthetic oligonucleotide
  Description of Artificial Sequence: Synthetic oligonucleotide
gauugauguuuaccgaagutt

SEQ ID NO: 478 - DNA, 21 bp, Artificial Sequence
  Description of Combined DNA/RNA Molecule: Synthetic oligonucleotide
  Description of Artificial Sequence: Synthetic oligonucleotide
acuucgguaaacaucaauctt

SEQ ID NO: 479 - DNA, 21 bp, Artificial Sequence
  Description of Combined DNA/RNA Molecule: Synthetic oligonucleotide
  Description of Artificial Sequence: Synthetic oligonucleotide
gcacuaucuuugcguauggtt

SEQ ID NO: 480 - DNA, 21 bp, Artificial Sequence
  Description of Combined DNA/RNA Molecule: Synthetic oligonucleotide
  Description of Artificial Sequence: Synthetic oligonucleotide
ccauacgcaaagauagugctt

SEQ ID NO: 481 - DNA, 21 bp, Artificial Sequence
  Description of Combined DNA/RNA Molecule: Synthetic oligonucleotide
  Description of Artificial Sequence: Synthetic oligonucleotide
ugguauaauuccacguacctt

SEQ ID NO: 482 - DNA, 21 bp, Artificial Sequence
  Description of Combined DNA/RNA Molecule: Synthetic oligonucleotide
  Description of Artificial Sequence: Synthetic oligonucleotide
gguacguggaauuauaccatt

SEQ ID NO: 483 - DNA, 21 bp, Artificial Sequence
  Description of Combined DNA/RNA Molecule: Synthetic oligonucleotide
  Description of Artificial Sequence: Synthetic oligonucleotide
agcaagcugcuuaacacagtt

SEQ ID NO: 484 - DNA, 21 bp, Artificial Sequence
  Description of Combined DNA/RNA Molecule: Synthetic oligonucleotide
  Description of Artificial Sequence: Synthetic oligonucleotide
cuguguuaagcagcuugcutt

SEQ ID NO: 485 - DNA, 21 bp, Artificial Sequence
  Description of Combined DNA/RNA Molecule: Synthetic oligonucleotide
  Description of Artificial Sequence: Synthetic oligonucleotide
cagaaaccacuuaguagugtt

SEQ ID NO: 486 - DNA, 21 bp, Artificial Sequence
  Description of Combined DNA/RNA Molecule: Synthetic oligonucleotide
  Description of Artificial Sequence: Synthetic oligonucleotide
cacuacuaagugguuucugtt

SEQ ID NO: 487 - DNA, 21 bp, Artificial Sequence
  Description of Combined DNA/RNA Molecule: Synthetic oligonucleotide
  Description of Artificial Sequence: Synthetic oligonucleotide
aacuuauuggagguuguaatt

SEQ ID NO: 488 - DNA, 21 bp, Artificial Sequence
  Description of Combined DNA/RNA Molecule: Synthetic oligonucleotide
  Description of Artificial Sequence: Synthetic oligonucleotide
uuacaaccuccaauaaguutt

SEQ ID NO: 489 - DNA, 21 bp, Artificial Sequence
  Description of Combined DNA/RNA Molecule: Synthetic oligonucleotide
  Description of Artificial Sequence: Synthetic oligonucleotide
cuggagaggucuaaaguggtt

SEQ ID NO: 490 - DNA, 21 bp, Artificial Sequence
  Description of Combined DNA/RNA Molecule: Synthetic oligonucleotide
  Description of Artificial Sequence: Synthetic oligonucleotide
ccacuuuagaccucuccagtt

SEQ ID NO: 491 - DNA, 21 bp, Artificial Sequence
  Description of Combined DNA/RNA Molecule: Synthetic oligonucleotide
  Description of Artificial Sequence: Synthetic oligonucleotide
aaaaaagauauaaggcagutt

SEQ ID NO: 492 - DNA, 21 bp, Artificial Sequence
  Description of Combined DNA/RNA Molecule: Synthetic oligonucleotide
  Description of Artificial Sequence: Synthetic oligonucleotide
acugccuuauaucuuuuuutt

SEQ ID NO: 493 - DNA, 21 bp, Artificial Sequence
  Description of Combined DNA/RNA Molecule: Synthetic oligonucleotide
  Description of Artificial Sequence: Synthetic oligonucleotide
gaauuuugauaucuacccatt

SEQ ID NO: 494 - DNA, 21 bp, Artificial Sequence
  Description of Combined DNA/RNA Molecule: Synthetic oligonucleotide
  Description of Artificial Sequence: Synthetic oligonucleotide
uggguagauaucaaaauuctt

SEQ ID NO: 495 - DNA, 21 bp, Artificial Sequence
  Description of Combined DNA/RNA Molecule: Synthetic oligonucleotide
  Description of Artificial Sequence: Synthetic oligonucleotide
guauuuuugaucuggcaactt

SEQ ID NO: 496 - DNA, 21 bp, Artificial Sequence
  Description of Combined DNA/RNA Molecule: Synthetic oligonucleotide
  Description of Artificial Sequence: Synthetic oligonucleotide
guugccagaucaaaaauactt

SEQ ID NO: 497 - DNA, 21 bp, Artificial Sequence
  Description of Combined DNA/RNA Molecule: Synthetic oligonucleotide
  Description of Artificial Sequence: Synthetic oligonucleotide
aggaucccuuggcugguautt

SEQ ID NO: 498 - DNA, 21 bp, Artificial Sequence
  Description of Combined DNA/RNA Molecule: Synthetic oligonucleotide
  Description of Artificial Sequence: Synthetic oligonucleotide
auaccagccaagggauccutt

SEQ ID NO: 499 - DNA, 21 bp, Artificial Sequence
  Description of Combined DNA/RNA Molecule: Synthetic oligonucleotide
  Description of Artificial Sequence: Synthetic oligonucleotide
ggaucccuuggcugguauatt

SEQ ID NO: 500 - DNA, 21 bp, Artificial Sequence
  Description of Combined DNA/RNA Molecule: Synthetic oligonucleotide
  Description of Artificial Sequence: Synthetic oligonucleotide
uauaccagccaagggaucctt

SEQ ID NO: 501 - DNA, 21 bp, Artificial Sequence
  Description of Combined DNA/RNA Molecule: Synthetic oligonucleotide
  Description of Artificial Sequence: Synthetic oligonucleotide
caauaguagaaugugaucctt

SEQ ID NO: 502 - DNA, 21 bp, Artificial Sequence
  Description of Combined DNA/RNA Molecule: Synthetic oligonucleotide
  Description of Artificial Sequence: Synthetic oligonucleotide
ggaucacauucuacuauugtt

SEQ ID NO: 503 - DNA, 21 bp, Artificial Sequence
  Description of Combined DNA/RNA Molecule: Synthetic oligonucleotide
  Description of Artificial Sequence: Synthetic oligonucleotide
gcuauaauugcacuaucuutt

SEQ ID NO: 504 - DNA, 21 bp, Artificial Sequence
  Description of Combined DNA/RNA Molecule: Synthetic oligonucleotide
  Description of Artificial Sequence: Synthetic oligonucleotide
aagauagugcaauuauagctt

SEQ ID NO: 505 - DNA, 21 bp, Artificial Sequence
  Description of Combined DNA/RNA Molecule: Synthetic oligonucleotide
  Description of Artificial Sequence: Synthetic oligonucleotide
uacccuucaucaaauuuuutt

SEQ ID NO: 506 - DNA, 21 bp, Artificial Sequence
  Description of Combined DNA/RNA Molecule: Synthetic oligonucleotide
  Description of Artificial Sequence: Synthetic oligonucleotide
aaaaauuugaugaaggguatt

SEQ ID NO: 507 - DNA, 21 bp, Artificial Sequence
  Description of Combined DNA/RNA Molecule: Synthetic oligonucleotide
  Description of Artificial Sequence: Synthetic oligonucleotide
agaacauauugaauaagcctt

SEQ ID NO: 508 - DNA, 21 bp, Artificial Sequence
  Description of Combined DNA/RNA Molecule: Synthetic oligonucleotide
  Description of Artificial Sequence: Synthetic oligonucleotide
ggcuuauucaauauguucutt

SEQ ID NO: 509 - DNA, 21 bp, Artificial Sequence
  Description of Combined DNA/RNA Molecule: Synthetic oligonucleotide
  Description of Artificial Sequence: Synthetic oligonucleotide
aaauuggugcuguugaggatt

SEQ ID NO: 510 - DNA, 21 bp, Artificial Sequence
  Description of Combined DNA/RNA Molecule: Synthetic oligonucleotide
  Description of Artificial Sequence: Synthetic oligonucleotide
uccucaacagcaccaauuutt

SEQ ID NO: 511 - DNA, 21 bp, Artificial Sequence
  Description of Combined DNA/RNA Molecule: Synthetic oligonucleotide
  Description of Artificial Sequence: Synthetic oligonucleotide
ugaauaggguuacagaguutt

SEQ ID NO: 512 - DNA, 21 bp, Artificial Sequence
  Description of Combined DNA/RNA Molecule: Synthetic oligonucleotide
  Description of Artificial Sequence: Synthetic oligonucleotide
aacucuguaacccuauucatt

SEQ ID NO: 513 - DNA, 21 bp, Artificial Sequence
  Description of Combined DNA/RNA Molecule: Synthetic oligonucleotide
  Description of Artificial Sequence: Synthetic oligonucleotide
aagaacuugaaaccacucatt

SEQ ID NO: 514 - DNA, 21 bp, Artificial Sequence
  Description of Combined DNA/RNA Molecule: Synthetic oligonucleotide
  Description of Artificial Sequence: Synthetic oligonucleotide
ugagugguuucaaguucuutt

SEQ ID NO: 515 - DNA, 21 bp, Artificial Sequence
  Description of Combined DNA/RNA Molecule: Synthetic oligonucleotide
  Description of Artificial Sequence: Synthetic oligonucleotide
aauaaagcagacccauucctt

SEQ ID NO: 516 - DNA, 21 bp, Artificial Sequence
  Description of Combined DNA/RNA Molecule: Synthetic oligonucleotide
  Description of Artificial Sequence: Synthetic oligonucleotide
ggaaugggucugcuuuauutt

SEQ ID NO: 517 - DNA, 21 bp, Artificial Sequence
  Description of Combined DNA/RNA Molecule: Synthetic oligonucleotide
  Description of Artificial Sequence: Synthetic oligonucleotide
auacccaucaacacugguatt

SEQ ID NO: 518 - DNA, 21 bp, Artificial Sequence
  Description of Combined DNA/RNA Molecule: Synthetic oligonucleotide
  Description of Artificial Sequence: Synthetic oligonucleotide
uaccaguguugauggguautt

SEQ ID NO: 519 - DNA, 21 bp, Artificial Sequence
  Description of Combined DNA/RNA Molecule: Synthetic oligonucleotide
  Description of Artificial Sequence: Synthetic oligonucleotide
uggauuguucaucaauuggtt

SEQ ID NO: 520 - DNA, 21 bp, Artificial Sequence
  Description of Combined DNA/RNA Molecule: Synthetic oligonucleotide
  Description of Artificial Sequence: Synthetic oligonucleotide
ccaauugaugaacaauccatt

SEQ ID NO: 521 - DNA, 21 bp, Artificial Sequence
  Description of Combined DNA/RNA Molecule: Synthetic oligonucleotide
  Description of Artificial Sequence: Synthetic oligonucleotide
uggagaggucuaaaguggatt

SEQ ID NO: 522 - DNA, 21 bp, Artificial Sequence
  Description of Combined DNA/RNA Molecule: Synthetic oligonucleotide
  Description of Artificial Sequence: Synthetic oligonucleotide
uccacuuuagaccucuccatt

SEQ ID NO: 523 - DNA, 21 bp, Artificial Sequence
  Description of Combined DNA/RNA Molecule: Synthetic oligonucleotide
  Description of Artificial Sequence: Synthetic oligonucleotide
gucaucccuauaguucacutt

SEQ ID NO: 524 - DNA, 21 bp, Artificial Sequence
  Description of Combined DNA/RNA Molecule: Synthetic oligonucleotide
  Description of Artificial Sequence: Synthetic oligonucleotide
agugaacuauagggaugactt

SEQ ID NO: 525 - DNA, 21 bp, Artificial Sequence
  Description of Combined DNA/RNA Molecule: Synthetic oligonucleotide
  Description of Artificial Sequence: Synthetic oligonucleotide
auaauggcuauaauuucuctt

SEQ ID NO: 526 - DNA, 21 bp, Artificial Sequence
  Description of Combined DNA/RNA Molecule: Synthetic oligonucleotide
  Description of Artificial Sequence: Synthetic oligonucleotide
gagaaauuauagccauuautt

SEQ ID NO: 527 - DNA, 21 bp, Artificial Sequence
  Description of Combined DNA/RNA Molecule: Synthetic oligonucleotide
  Description of Artificial Sequence: Synthetic oligonucleotide
aucccuuggcugguauaautt

SEQ ID NO: 528 - DNA, 21 bp, Artificial Sequence
  Description of Combined DNA/RNA Molecule: Synthetic oligonucleotide
  Description of Artificial Sequence: Synthetic oligonucleotide
auuauaccagccaagggautt

SEQ ID NO: 529 - DNA, 21 bp, Artificial Sequence
  Description of Combined DNA/RNA Molecule: Synthetic oligonucleotide
  Description of Artificial Sequence: Synthetic oligonucleotide
gggcuauaauugcacuauctt

SEQ ID NO: 530 - DNA, 21 bp, Artificial Sequence
  Description of Combined DNA/RNA Molecule: Synthetic oligonucleotide
  Description of Artificial Sequence: Synthetic oligonucleotide
gauagugcaauuauagccctt

SEQ ID NO: 531 - DNA, 21 bp, Artificial Sequence
  Description of Combined DNA/RNA Molecule: Synthetic oligonucleotide
  Description of Artificial Sequence: Synthetic oligonucleotide
gauucucuuggagggcguatt

SEQ ID NO: 532 - DNA, 21 bp, Artificial Sequence
  Description of Combined DNA/RNA Molecule: Synthetic oligonucleotide
  Description of Artificial Sequence: Synthetic oligonucleotide
uacgcccuccaagagaauctt

SEQ ID NO: 533 - DNA, 21 bp, Artificial Sequence
  Description of Combined DNA/RNA Molecule: Synthetic oligonucleotide
  Description of Artificial Sequence: Synthetic oligonucleotide
gcaucucucaaucuugaggtt

SEQ ID NO: 534 - DNA, 21 bp, Artificial Sequence
  Description of Combined DNA/RNA Molecule: Synthetic oligonucleotide
  Description of Artificial Sequence: Synthetic oligonucleotide
ccucaagauugagagaugctt

SEQ ID NO: 535 - DNA, 21 bp, Artificial Sequence
  Description of Combined DNA/RNA Molecule: Synthetic oligonucleotide
  Description of Artificial Sequence: Synthetic oligonucleotide
cagcagaaaucuaaggauatt

SEQ ID NO: 536 - DNA, 21 bp, Artificial Sequence
  Description of Combined DNA/RNA Molecule: Synthetic oligonucleotide
  Description of Artificial Sequence: Synthetic oligonucleotide
uauccuuagauuucugcugtt

SEQ ID NO: 537 - DNA, 21 bp, Artificial Sequence
  Description of Combined DNA/RNA Molecule: Synthetic oligonucleotide
  Description of Artificial Sequence: Synthetic oligonucleotide
gucaagagccaucuguagatt

SEQ ID NO: 538 - DNA, 21 bp, Artificial Sequence
  Description of Combined DNA/RNA Molecule: Synthetic oligonucleotide
  Description of Artificial Sequence: Synthetic oligonucleotide
ucuacagauggcucuugactt

SEQ ID NO: 539 - DNA, 21 bp, Artificial Sequence
  Description of Combined DNA/RNA Molecule: Synthetic oligonucleotide
  Description of Artificial Sequence: Synthetic oligonucleotide
aaacagaggcauuaacacatt

SEQ ID NO: 540 - DNA, 21 bp, Artificial Sequence
  Description of Combined DNA/RNA Molecule: Synthetic oligonucleotide
  Description of Artificial Sequence: Synthetic oligonucleotide
uguguuaaugccucuguuutt

SEQ ID NO: 541 - DNA, 21 bp, Artificial Sequence
  Description of Combined DNA/RNA Molecule: Synthetic oligonucleotide
  Description of Artificial Sequence: Synthetic oligonucleotide
agcccagaucaaccuuuaatt

SEQ ID NO: 542 - DNA, 21 bp, Artificial Sequence
  Description of Combined DNA/RNA Molecule: Synthetic oligonucleotide
  Description of Artificial Sequence: Synthetic oligonucleotide
uuaaagguugaucugggcutt

SEQ ID NO: 543 - DNA, 21 bp, Artificial Sequence
  Description of Combined DNA/RNA Molecule: Synthetic oligonucleotide
  Description of Artificial Sequence: Synthetic oligonucleotide
uauuuuugaucuggcaacctt

SEQ ID NO: 544 - DNA, 21 bp, Artificial Sequence
  Description of Combined DNA/RNA Molecule: Synthetic oligonucleotide
  Description of Artificial Sequence: Synthetic oligonucleotide
gguugccagaucaaaaauatt

SEQ ID NO: 545 - DNA, 21 bp, Artificial Sequence
  Description of Combined DNA/RNA Molecule: Synthetic oligonucleotide
  Description of Artificial Sequence: Synthetic oligonucleotide
uguuuggagcaucuacuaatt

SEQ ID NO: 546 - DNA, 21 bp, Artificial Sequence
  Description of Combined DNA/RNA Molecule: Synthetic oligonucleotide
  Description of Artificial Sequence: Synthetic oligonucleotide
uuaguagaugcuccaaacatt

SEQ ID NO: 547 - DNA, 21 bp, Artificial Sequence
  Description of Combined DNA/RNA Molecule: Synthetic oligonucleotide
  Description of Artificial Sequence: Synthetic oligonucleotide
gaaauuacaguacacaacatt

SEQ ID NO: 548 - DNA, 21 bp, Artificial Sequence
  Description of Combined DNA/RNA Molecule: Synthetic oligonucleotide
  Description of Artificial Sequence: Synthetic oligonucleotide
uguuguguacuguaauuuctt

SEQ ID NO: 549 - DNA, 21 bp, Artificial Sequence
  Description of Combined DNA/RNA Molecule: Synthetic oligonucleotide
  Description of Artificial Sequence: Synthetic oligonucleotide
acuugaccaguguaaaucutt

SEQ ID NO: 550 - DNA, 21 bp, Artificial Sequence
  Description of Combined DNA/RNA Molecule: Synthetic oligonucleotide
  Description of Artificial Sequence: Synthetic oligonucleotide
agauuuacacuggucaagutt

SEQ ID NO: 551 - DNA, 21 bp, Artificial Sequence
  Description of Combined DNA/RNA Molecule: Synthetic oligonucleotide
  Description of Artificial Sequence: Synthetic oligonucleotide
accaguguaaaucugaccutt

SEQ ID NO: 552 - DNA, 21 bp, Artificial Sequence
  Description of Combined DNA/RNA Molecule: Synthetic oligonucleotide
  Description of Artificial Sequence: Synthetic oligonucleotide
aggucagauuuacacuggutt

SEQ ID NO: 553 - DNA, 21 bp, Artificial Sequence
  Description of Combined DNA/RNA Molecule: Synthetic oligonucleotide
  Description of Artificial Sequence: Synthetic oligonucleotide
agaacaaucauuagcagcatt

SEQ ID NO: 554 - DNA, 21 bp, Artificial Sequence
  Description of Combined DNA/RNA Molecule: Synthetic oligonucleotide
  Description of Artificial Sequence: Synthetic oligonucleotide
ugcugcuaaugauuguucutt

SEQ ID NO: 555 - DNA, 21 bp, Artificial Sequence
  Description of Combined DNA/RNA Molecule: Synthetic oligonucleotide
  Description of Artificial Sequence: Synthetic oligonucleotide
caauguggaaaccuaacugtt

SEQ ID NO: 556 - DNA, 21 bp, Artificial Sequence
  Description of Combined DNA/RNA Molecule: Synthetic oligonucleotide
  Description of Artificial Sequence: Synthetic oligonucleotide
caguuagguuuccacauugtt

SEQ ID NO: 557 - DNA, 21 bp, Artificial Sequence
  Description of Combined DNA/RNA Molecule: Synthetic oligonucleotide
  Description of Artificial Sequence: Synthetic oligonucleotide
accaagaagguacaaaauutt

SEQ ID NO: 558 - DNA, 21 bp, Artificial Sequence
  Description of Combined DNA/RNA Molecule: Synthetic oligonucleotide
  Description of Artificial Sequence: Synthetic oligonucleotide
aauuuuguaccuucuuggutt

SEQ ID NO: 559 - DNA, 21 bp, Artificial Sequence
  Description of Combined DNA/RNA Molecule: Synthetic oligonucleotide
  Description of Artificial Sequence: Synthetic oligonucleotide
gguacaaaauugguugaagtt

SEQ ID NO: 560 - DNA, 21 bp, Artificial Sequence
  Description of Combined DNA/RNA Molecule: Synthetic oligonucleotide
  Description of Artificial Sequence: Synthetic oligonucleotide
cuucaaccaauuuuguacctt

SEQ ID NO: 561 - DNA, 21 bp, Artificial Sequence
  Description of Combined DNA/RNA Molecule: Synthetic oligonucleotide
  Description of Artificial Sequence: Synthetic oligonucleotide
gguguggauuguucaucaatt

SEQ ID NO: 562 - DNA, 21 bp, Artificial Sequence
  Description of Combined DNA/RNA Molecule: Synthetic oligonucleotide
  Description of Artificial Sequence: Synthetic oligonucleotide
uugaugaacaauccacacctt

SEQ ID NO: 563 - DNA, 21 bp, Artificial Sequence
  Description of Combined DNA/RNA Molecule: Synthetic oligonucleotide
  Description of Artificial Sequence: Synthetic oligonucleotide
agaguucacaaaaagcccatt

SEQ ID NO: 564 - DNA, 21 bp, Artificial Sequence
  Description of Combined DNA/RNA Molecule: Synthetic oligonucleotide
  Description of Artificial Sequence: Synthetic oligonucleotide
ugggcuuuuugugaacucutt

SEQ ID NO: 565 - DNA, 21 bp, Artificial Sequence
  Description of Combined DNA/RNA Molecule: Synthetic oligonucleotide
  Description of Artificial Sequence: Synthetic oligonucleotide
ugauagcuaaauuaaaccatt

SEQ ID NO: 566 - DNA, 21 bp, Artificial Sequence
  Description of Combined DNA/RNA Molecule: Synthetic oligonucleotide
  Description of Artificial Sequence: Synthetic oligonucleotide
ugguuuaauuuagcuaucatt

SEQ ID NO: 567 - DNA, 21 bp, Artificial Sequence
  Description of Combined DNA/RNA Molecule: Synthetic oligonucleotide
  Description of Artificial Sequence: Synthetic oligonucleotide
aauaagccugaagugaauctt

SEQ ID NO: 568 - DNA, 21 bp, Artificial Sequence
  Description of Combined DNA/RNA Molecule: Synthetic oligonucleotide
  Description of Artificial Sequence: Synthetic oligonucleotide
gauucacuucaggcuuauutt

SEQ ID NO: 569 - DNA, 21 bp, Artificial Sequence
  Description of Combined DNA/RNA Molecule: Synthetic oligonucleotide
  Description of Artificial Sequence: Synthetic oligonucleotide
caguugaccaacacaaugctt

SEQ ID NO: 570 - DNA, 21 bp, Artificial Sequence
  Description of Combined DNA/RNA Molecule: Synthetic oligonucleotide
  Description of Artificial Sequence: Synthetic oligonucleotide
gcauuguguuggucaacugtt

SEQ ID NO: 571 - DNA, 21 bp, Artificial Sequence
  Description of Combined DNA/RNA Molecule: Synthetic oligonucleotide
  Description of Artificial Sequence: Synthetic oligonucleotide
ugguguggauuguucaucatt

SEQ ID NO: 572 - DNA, 21 bp, Artificial Sequence
  Description of Combined DNA/RNA Molecule: Synthetic oligonucleotide
  Description of Artificial Sequence: Synthetic oligonucleotide
ugaugaacaauccacaccatt

SEQ ID NO: 573 - DNA, 21 bp, Artificial Sequence
  Description of Combined DNA/RNA Molecule: Synthetic oligonucleotide
  Description of Artificial Sequence: Synthetic oligonucleotide
auucacccugacagaguuctt

SEQ ID NO: 574 - DNA, 21 bp, Artificial Sequence
  Description of Combined DNA/RNA Molecule: Synthetic oligonucleotide
  Description of Artificial Sequence: Synthetic oligonucleotide
gaacucugucagggugaautt

SEQ ID NO: 575 - DNA, 21 bp, Artificial Sequence
  Description of Combined DNA/RNA Molecule: Synthetic oligonucleotide
  Description of Artificial Sequence: Synthetic oligonucleotide
uaagaccuuauuugguaautt

SEQ ID NO: 576 - DNA, 21 bp, Artificial Sequence
  Description of Combined DNA/RNA Molecule: Synthetic oligonucleotide
  Description of Artificial Sequence: Synthetic oligonucleotide
auuaccaaauaaggucuuatt

SEQ ID NO: 577 - DNA, 21 bp, Artificial Sequence
  Description of Combined DNA/RNA Molecule: Synthetic oligonucleotide
  Description of Artificial Sequence: Synthetic oligonucleotide
aagcaauguggaaaccuaatt

SEQ ID NO: 578 - DNA, 21 bp, Artificial Sequence
  Description of Combined DNA/RNA Molecule: Synthetic oligonucleotide
  Description of Artificial Sequence: Synthetic oligonucleotide
uuagguuuccacauugcuutt

SEQ ID NO: 579 - DNA, 21 bp, Artificial Sequence
  Description of Combined DNA/RNA Molecule: Synthetic oligonucleotide
  Description of Artificial Sequence: Synthetic oligonucleotide
ucugaaacuggauaucccatt

SEQ ID NO: 580 - DNA, 21 bp, Artificial Sequence
  Description of Combined DNA/RNA Molecule: Synthetic oligonucleotide
  Description of Artificial Sequence: Synthetic oligonucleotide
ugggauauccaguuucagatt

SEQ ID NO: 581 - skipped

SEQ ID NO: 582 - DNA, 21 bp, Artificial Sequence
  Description of Combined DNA/RNA Molecule: Synthetic oligonucleotide
  Description of Artificial Sequence: Synthetic oligonucleotide
ccauuacuacaguagcacutt

SEQ ID NO: 583 - DNA, 21 bp, Artificial Sequence
  Description of Combined DNA/RNA Molecule: Synthetic oligonucleotide
  Description of Artificial Sequence: Synthetic oligonucleotide
agugcuacuguaguaauggtt

SEQ ID NO: 584 - DNA, 21 bp, Artificial Sequence
  Description of Combined DNA/RNA Molecule: Synthetic oligonucleotide
  Description of Artificial Sequence: Synthetic oligonucleotide
aucuggcaaccauauuucutt

SEQ ID NO: 585 - DNA, 21 bp, Artificial Sequence
  Description of Combined DNA/RNA Molecule: Synthetic oligonucleotide
  Description of Artificial Sequence: Synthetic oligonucleotide
agaaauaugguugccagautt

SEQ ID NO: 586 - DNA, 21 bp, Artificial Sequence
  Description of Combined DNA/RNA Molecule: Synthetic oligonucleotide
  Description of Artificial Sequence: Synthetic oligonucleotide
gauagcuaaauuaaaccaatt

SEQ ID NO: 587 - DNA, 21 bp, Artificial Sequence
  Description of Combined DNA/RNA Molecule: Synthetic oligonucleotide
  Description of Artificial Sequence: Synthetic oligonucleotide
uugguuuaauuuagcuauctt

SEQ ID NO: 588 - DNA, 21 bp, Artificial Sequence
  Description of Combined DNA/RNA Molecule: Synthetic oligonucleotide
  Description of Artificial Sequence: Synthetic oligonucleotide
agauaccauuacuacaguatt

SEQ ID NO: 589 - DNA, 21 bp, Artificial Sequence
  Description of Combined DNA/RNA Molecule: Synthetic oligonucleotide
  Description of Artificial Sequence: Synthetic oligonucleotide
uacuguaguaaugguaucutt

SEQ ID NO: 590 - DNA, 21 bp, Artificial Sequence
  Description of Combined DNA/RNA Molecule: Synthetic oligonucleotide
  Description of Artificial Sequence: Synthetic oligonucleotide
gauuguucaucaauuggcgtt

SEQ ID NO: 591 - DNA, 21 bp, Artificial Sequence
  Description of Combined DNA/RNA Molecule: Synthetic oligonucleotide
  Description of Artificial Sequence: Synthetic oligonucleotide
cgccaauugaugaacaauctt

SEQ ID NO: 592 - DNA, 21 bp, Artificial Sequence
  Description of Combined DNA/RNA Molecule: Synthetic oligonucleotide
  Description of Artificial Sequence: Synthetic oligonucleotide
gcuuucuccucggcucacutt

SEQ ID NO: 593 - DNA, 21 bp, Artificial Sequence
  Description of Combined DNA/RNA Molecule: Synthetic oligonucleotide
  Description of Artificial Sequence: Synthetic oligonucleotide
agugagccgaggagaaagctt

SEQ ID NO: 594 - DNA, 21 bp, Artificial Sequence
  Description of Combined DNA/RNA Molecule: Synthetic oligonucleotide
  Description of Artificial Sequence: Synthetic oligonucleotide
ggaggauuggcugacaagatt

SEQ ID NO: 595 - DNA, 21 bp, Artificial Sequence
  Description of Combined DNA/RNA Molecule: Synthetic oligonucleotide
  Description of Artificial Sequence: Synthetic oligonucleotide
ucuugucagccaauccucctt

SEQ ID NO: 596 - DNA, 21 bp, Artificial Sequence
  Description of Combined DNA/RNA Molecule: Synthetic oligonucleotide
  Description of Artificial Sequence: Synthetic oligonucleotide
uaaugaagaguauaccuggtt

SEQ ID NO: 597 - DNA, 21 bp, Artificial Sequence
  Description of Combined DNA/RNA Molecule: Synthetic oligonucleotide
  Description of Artificial Sequence: Synthetic oligonucleotide
ccagguauacucuucauuatt

SEQ ID NO: 598 - DNA, 21 bp, Artificial Sequence
  Description of Combined DNA/RNA Molecule: Synthetic oligonucleotide
  Description of Artificial Sequence: Synthetic oligonucleotide
uuucaccaaaccauuuguatt

SEQ ID NO: 599 - DNA, 21 bp, Artificial Sequence
  Description of Combined DNA/RNA Molecule: Synthetic oligonucleotide
  Description of Artificial Sequence: Synthetic oligonucleotide
uacaaaugguuuggugaaatt

SEQ ID NO: 600 - DNA, 21 bp, Artificial Sequence
  Description of Combined DNA/RNA Molecule: Synthetic oligonucleotide
  Description of Artificial Sequence: Synthetic oligonucleotide
cuuauuaaggaguauacggtt

SEQ ID NO: 601 - DNA, 21 bp, Artificial Sequence
  Description of Combined DNA/RNA Molecule: Synthetic oligonucleotide
  Description of Artificial Sequence: Synthetic oligonucleotide
ccguauacuccuuaauaagtt

SEQ ID NO: 602 - DNA, 21 bp, Artificial Sequence
  Description of Combined DNA/RNA Molecule: Synthetic oligonucleotide
  Description of Artificial Sequence: Synthetic oligonucleotide
gaaaucagauggacguaagtt

SEQ ID NO: 603 - DNA, 21 bp, Artificial Sequence
  Description of Combined DNA/RNA Molecule: Synthetic oligonucleotide
  Description of Artificial Sequence: Synthetic oligonucleotide
cuuacguccaucugauuuctt

SEQ ID NO: 604 - DNA, 21 bp, Artificial Sequence
  Description of Combined DNA/RNA Molecule: Synthetic oligonucleotide
  Description of Artificial Sequence: Synthetic oligonucleotide
cagaugucagcauaagcgatt

SEQ ID NO: 605 - DNA, 21 bp, Artificial Sequence
  Description of Combined DNA/RNA Molecule: Synthetic oligonucleotide
  Description of Artificial Sequence: Synthetic oligonucleotide
ucgcuuaugcugacaucugtt

SEQ ID NO: 606 - DNA, 21 bp, Artificial Sequence
  Description of Combined DNA/RNA Molecule: Synthetic oligonucleotide
  Description of Artificial Sequence: Synthetic oligonucleotide
aucuaacccuaguuguauctt

SEQ ID NO: 607 - DNA, 21 bp, Artificial Sequence
  Description of Combined DNA/RNA Molecule: Synthetic oligonucleotide
  Description of Artificial Sequence: Synthetic oligonucleotide
gauacaacuaggguuagautt

SEQ ID NO: 608 - DNA, 21 bp, Artificial Sequence
  Description of Combined DNA/RNA Molecule: Synthetic oligonucleotide
  Description of Artificial Sequence: Synthetic oligonucleotide
aagagcuuguuaaaaucggtt

SEQ ID NO: 609 - DNA, 21 bp, Artificial Sequence
  Description of Combined DNA/RNA Molecule: Synthetic oligonucleotide
  Description of Artificial Sequence: Synthetic oligonucleotide
ccgauuuuaacaagcucuutt

SEQ ID NO: 610 - DNA, 21 bp, Artificial Sequence
  Description of Combined DNA/RNA Molecule: Synthetic oligonucleotide
  Description of Artificial Sequence: Synthetic oligonucleotide
uuaaggaguauacggaggatt

SEQ ID NO: 611 - DNA, 21 bp, Artificial Sequence
  Description of Combined DNA/RNA Molecule: Synthetic oligonucleotide
  Description of Artificial Sequence: Synthetic oligonucleotide
uccuccguauacuccuuaatt

SEQ ID NO: 612 - DNA, 21 bp, Artificial Sequence
  Description of Combined DNA/RNA Molecule: Synthetic oligonucleotide
  Description of Artificial Sequence: Synthetic oligonucleotide
uugcaauguaaauacguautt

SEQ ID NO: 613 - DNA, 21 bp, Artificial Sequence
  Description of Combined DNA/RNA Molecule: Synthetic oligonucleotide
  Description of Artificial Sequence: Synthetic oligonucleotide
auacguauuuacauugcaatt

SEQ ID NO: 614 - DNA, 21 bp, Artificial Sequence
  Description of Combined DNA/RNA Molecule: Synthetic oligonucleotide
  Description of Artificial Sequence: Synthetic oligonucleotide
ucuaacccuaguuguaucctt

SEQ ID NO: 615 - DNA, 21 bp, Artificial Sequence
  Description of Combined DNA/RNA Molecule: Synthetic oligonucleotide
  Description of Artificial Sequence: Synthetic oligonucleotide
ggauacaacuaggguuagatt

SEQ ID NO: 616 - DNA, 21 bp, Artificial Sequence
  Description of Combined DNA/RNA Molecule: Synthetic oligonucleotide
  Description of Artificial Sequence: Synthetic oligonucleotide
cauguaucuuuuucucgautt

SEQ ID NO: 617 - DNA, 21 bp, Artificial Sequence
  Description of Combined DNA/RNA Molecule: Synthetic oligonucleotide
  Description of Artificial Sequence: Synthetic oligonucleotide
aucgagaaaaagauacaugtt

SEQ ID NO: 618 - DNA, 21 bp, Artificial Sequence
  Description of Combined DNA/RNA Molecule: Synthetic oligonucleotide
  Description of Artificial Sequence: Synthetic oligonucleotide
gaugucagcauaagcgaugtt

SEQ ID NO: 619 - DNA, 21 bp, Artificial Sequence
  Description of Combined DNA/RNA Molecule: Synthetic oligonucleotide
  Description of Artificial Sequence: Synthetic oligonucleotide
caucgcuuaugcugacauctt

SEQ ID NO: 620 - DNA, 21 bp, Artificial Sequence
  Description of Combined DNA/RNA Molecule: Synthetic oligonucleotide
  Description of Artificial Sequence: Synthetic oligonucleotide
ucccaacagguacgacacctt

SEQ ID NO: 621 - DNA, 21 bp, Artificial Sequence
  Description of Combined DNA/RNA Molecule: Synthetic oligonucleotide
  Description of Artificial Sequence: Synthetic oligonucleotide
ggugucguaccuguugggatt

SEQ ID NO: 622 - DNA, 21 bp, Artificial Sequence
  Description of Combined DNA/RNA Molecule: Synthetic oligonucleotide
  Description of Artificial Sequence: Synthetic oligonucleotide
ugcucacgaugaguuuagutt

SEQ ID NO: 623 - DNA, 21 bp, Artificial Sequence
  Description of Combined DNA/RNA Molecule: Synthetic oligonucleotide
  Description of Artificial Sequence: Synthetic oligonucleotide
acuaaacucaucgugagcatt

SEQ ID NO: 624 - DNA, 21 bp, Artificial Sequence
  Description of Combined DNA/RNA Molecule: Synthetic oligonucleotide
  Description of Artificial Sequence: Synthetic oligonucleotide
agagcuuguuaaaaucggatt

SEQ ID NO: 625 - DNA, 21 bp, Artificial Sequence
  Description of Combined DNA/RNA Molecule: Synthetic oligonucleotide
  Description of Artificial Sequence: Synthetic oligonucleotide
uccgauuuuaacaagcucutt

SEQ ID NO: 626 - DNA, 21 bp, Artificial Sequence
  Description of Combined DNA/RNA Molecule: Synthetic oligonucleotide
  Description of Artificial Sequence: Synthetic oligonucleotide
gcguacaagaacaucuauatt

SEQ ID NO: 627 - DNA, 21 bp, Artificial Sequence
  Description of Combined DNA/RNA Molecule: Synthetic oligonucleotide
  Description of Artificial Sequence: Synthetic oligonucleotide
uauagauguucuuguacgctt

SEQ ID NO: 628 - DNA, 21 bp, Artificial Sequence
  Description of Combined DNA/RNA Molecule: Synthetic oligonucleotide
  Description of Artificial Sequence: Synthetic oligonucleotide
gagguuguaagccaauguutt

SEQ ID NO: 629 - DNA, 21 bp, Artificial Sequence
  Description of Combined DNA/RNA Molecule: Synthetic oligonucleotide
  Description of Artificial Sequence: Synthetic oligonucleotide
aacauuggcuuacaaccuctt

SEQ ID NO: 630 - DNA, 21 bp, Artificial Sequence
  Description of Combined DNA/RNA Molecule: Synthetic oligonucleotide
  Description of Artificial Sequence: Synthetic oligonucleotide
aacagguacgacaccacagtt

SEQ ID NO: 631 - DNA, 21 bp, Artificial Sequence
  Description of Combined DNA/RNA Molecule: Synthetic oligonucleotide
  Description of Artificial Sequence: Synthetic oligonucleotide
cuguggugucguaccuguutt

SEQ ID NO: 632 - DNA, 21 bp, Artificial Sequence
  Description of Combined DNA/RNA Molecule: Synthetic oligonucleotide
  Description of Artificial Sequence: Synthetic oligonucleotide
aacccuaguuguaucccuctt

SEQ ID NO: 633 - DNA, 21 bp, Artificial Sequence
  Description of Combined DNA/RNA Molecule: Synthetic oligonucleotide
  Description of Artificial Sequence: Synthetic oligonucleotide
gagggauacaacuaggguutt

SEQ ID NO: 634 - DNA, 21 bp, Artificial Sequence
  Description of Combined DNA/RNA Molecule: Synthetic oligonucleotide
  Description of Artificial Sequence: Synthetic oligonucleotide
gcauaagcgauggauaauatt

SEQ ID NO: 635 - DNA, 21 bp, Artificial Sequence
  Description of Combined DNA/RNA Molecule: Synthetic oligonucleotide
  Description of Artificial Sequence: Synthetic oligonucleotide
uauuauccaucgcuuaugctt

SEQ ID NO: 636 - DNA, 21 bp, Artificial Sequence
  Description of Combined DNA/RNA Molecule: Synthetic oligonucleotide
  Description of Artificial Sequence: Synthetic oligonucleotide
aagcgauggauaauaccuatt

SEQ ID NO: 637 - DNA, 21 bp, Artificial Sequence
  Description of Combined DNA/RNA Molecule: Synthetic oligonucleotide
  Description of Artificial Sequence: Synthetic oligonucleotide
uagguauuauccaucgcuutt

SEQ ID NO: 638 - DNA, 21 bp, Artificial Sequence
  Description of Combined DNA/RNA Molecule: Synthetic oligonucleotide
  Description of Artificial Sequence: Synthetic oligonucleotide
ugauccuguacgaaaagaatt

SEQ ID NO: 639 - DNA, 21 bp, Artificial Sequence
  Description of Combined DNA/RNA Molecule: Synthetic oligonucleotide
  Description of Artificial Sequence: Synthetic oligonucleotide
uucuuuucguacaggaucatt

SEQ ID NO: 640 - DNA, 21 bp, Artificial Sequence
  Description of Combined DNA/RNA Molecule: Synthetic oligonucleotide
  Description of Artificial Sequence: Synthetic oligonucleotide
aaaacauuggccguucuggtt

SEQ ID NO: 641 - DNA, 21 bp, Artificial Sequence
  Description of Combined DNA/RNA Molecule: Synthetic oligonucleotide
  Description of Artificial Sequence: Synthetic oligonucleotide
ccagaacggccaauguuuutt

SEQ ID NO: 642 - DNA, 21 bp, Artificial Sequence
  Description of Combined DNA/RNA Molecule: Synthetic oligonucleotide
  Description of Artificial Sequence: Synthetic oligonucleotide
cuuggagggcguacaagaatt

SEQ ID NO: 643 - DNA, 21 bp, Artificial Sequence
  Description of Combined DNA/RNA Molecule: Synthetic oligonucleotide
  Description of Artificial Sequence: Synthetic oligonucleotide
uucuuguacgcccuccaagtt

SEQ ID NO: 644 - DNA, 21 bp, Artificial Sequence
  Description of Combined DNA/RNA Molecule: Synthetic oligonucleotide
  Description of Artificial Sequence: Synthetic oligonucleotide
ggcguacaagaacaucuautt

SEQ ID NO: 645 - DNA, 21 bp, Artificial Sequence
  Description of Combined DNA/RNA Molecule: Synthetic oligonucleotide
  Description of Artificial Sequence: Synthetic oligonucleotide
auagauguucuuguacgcctt

SEQ ID NO: 646 - DNA, 21 bp, Artificial Sequence
  Description of Combined DNA/RNA Molecule: Synthetic oligonucleotide
  Description of Artificial Sequence: Synthetic oligonucleotide
acucugaguacauuggaautt

SEQ ID NO: 647 - DNA, 21 bp, Artificial Sequence
  Description of Combined DNA/RNA Molecule: Synthetic oligonucleotide
  Description of Artificial Sequence: Synthetic oligonucleotide
auuccaauguacucagagutt

SEQ ID NO: 648 - DNA, 21 bp, Artificial Sequence
  Description of Combined DNA/RNA Molecule: Synthetic oligonucleotide
  Description of Artificial Sequence: Synthetic oligonucleotide
uuauuaaggaguauacggatt

SEQ ID NO: 649 - DNA, 21 bp, Artificial Sequence
  Description of Combined DNA/RNA Molecule: Synthetic oligonucleotide
  Description of Artificial Sequence: Synthetic oligonucleotide
uccguauacuccuuaauaatt

SEQ ID NO: 650 - DNA, 21 bp, Artificial Sequence
  Description of Combined DNA/RNA Molecule: Synthetic oligonucleotide
  Description of Artificial Sequence: Synthetic oligonucleotide
uaaggaguauacggaggagtt

SEQ ID NO: 651 - DNA, 21 bp, Artificial Sequence
  Description of Combined DNA/RNA Molecule: Synthetic oligonucleotide
  Description of Artificial Sequence: Synthetic oligonucleotide
cuccuccguauacuccuuatt

SEQ ID NO: 652 - DNA, 21 bp, Artificial Sequence
  Description of Combined DNA/RNA Molecule: Synthetic oligonucleotide
  Description of Artificial Sequence: Synthetic oligonucleotide
aaaucaauagucaacuaaatt

SEQ ID NO: 653 - DNA, 21 bp, Artificial Sequence
  Description of Combined DNA/RNA Molecule: Synthetic oligonucleotide
  Description of Artificial Sequence: Synthetic oligonucleotide
uuuaguugacuauugauuutt

SEQ ID NO: 654 - DNA, 21 bp, Artificial Sequence
  Description of Combined DNA/RNA Molecule: Synthetic oligonucleotide
  Description of Artificial Sequence: Synthetic oligonucleotide
aaucaauagucaacuaaagtt

SEQ ID NO: 655 - DNA, 21 bp, Artificial Sequence
  Description of Combined DNA/RNA Molecule: Synthetic oligonucleotide
  Description of Artificial Sequence: Synthetic oligonucleotide
cuuuaguugacuauugauutt

SEQ ID NO: 656 - DNA, 21 bp, Artificial Sequence
  Description of Combined DNA/RNA Molecule: Synthetic oligonucleotide
  Description of Artificial Sequence: Synthetic oligonucleotide
uucucaguauacuguguaatt

SEQ ID NO: 657 - DNA, 21 bp, Artificial Sequence
  Description of Combined DNA/RNA Molecule: Synthetic oligonucleotide
  Description of Artificial Sequence: Synthetic oligonucleotide
uuacacaguauacugagaatt

SEQ ID NO: 658 - DNA, 21 bp, Artificial Sequence
  Description of Combined DNA/RNA Molecule: Synthetic oligonucleotide
  Description of Artificial Sequence: Synthetic oligonucleotide
ugugaaacacucugauaaatt

SEQ ID NO: 659 - DNA, 21 bp, Artificial Sequence
  Description of Combined DNA/RNA Molecule: Synthetic oligonucleotide
  Description of Artificial Sequence: Synthetic oligonucleotide
uuuaucagaguguuucacatt

SEQ ID NO: 660 - DNA, 21 bp, Artificial Sequence
  Description of Combined DNA/RNA Molecule: Synthetic oligonucleotide
  Description of Artificial Sequence: Synthetic oligonucleotide
agaugugaaucucugaacatt

SEQ ID NO: 661 - DNA, 21 bp, Artificial Sequence
  Description of Combined DNA/RNA Molecule: Synthetic oligonucleotide
  Description of Artificial Sequence: Synthetic oligonucleotide
uguucagagauucacaucutt

SEQ ID NO: 662 - DNA, 21 bp, Artificial Sequence
  Description of Combined DNA/RNA Molecule: Synthetic oligonucleotide
  Description of Artificial Sequence: Synthetic oligonucleotide
agguuguaagccaauguugtt

SEQ ID NO: 663 - DNA, 21 bp, Artificial Sequence
  Description of Combined DNA/RNA Molecule: Synthetic oligonucleotide
  Description of Artificial Sequence: Synthetic oligonucleotide
caacauuggcuuacaaccutt

SEQ ID NO: 664 - DNA, 21 bp, Artificial Sequence
  Description of Combined DNA/RNA Molecule: Synthetic oligonucleotide
  Description of Artificial Sequence: Synthetic oligonucleotide
ugagaaaucagauggacgutt

SEQ ID NO: 665 - DNA, 21 bp, Artificial Sequence
  Description of Combined DNA/RNA Molecule: Synthetic oligonucleotide
  Description of Artificial Sequence: Synthetic oligonucleotide
acguccaucugauuucucatt

SEQ ID NO: 666 - DNA, 21 bp, Artificial Sequence
  Description of Combined DNA/RNA Molecule: Synthetic oligonucleotide
  Description of Artificial Sequence: Synthetic oligonucleotide
agaaaucagauggacguaatt

SEQ ID NO: 667 - DNA, 21 bp, Artificial Sequence
  Description of Combined DNA/RNA Molecule: Synthetic oligonucleotide
  Description of Artificial Sequence: Synthetic oligonucleotide
uuacguccaucugauuucutt

SEQ ID NO: 668 - DNA, 21 bp, Artificial Sequence
  Description of Combined DNA/RNA Molecule: Synthetic oligonucleotide
  Description of Artificial Sequence: Synthetic oligonucleotide
auaucccaacagguacgactt

SEQ ID NO: 669 - DNA, 21 bp, Artificial Sequence
  Description of Combined DNA/RNA Molecule: Synthetic oligonucleotide
  Description of Artificial Sequence: Synthetic oligonucleotide
gucguaccuguugggauautt

SEQ ID NO: 670 - DNA, 21 bp, Artificial Sequence
  Description of Combined DNA/RNA Molecule: Synthetic oligonucleotide
  Description of Artificial Sequence: Synthetic oligonucleotide
cccaacagguacgacaccatt

SEQ ID NO: 671 - DNA, 21 bp, Artificial Sequence
  Description of Combined DNA/RNA Molecule: Synthetic oligonucleotide
  Description of Artificial Sequence: Synthetic oligonucleotide
uggugucguaccuguugggtt

SEQ ID NO: 672 - DNA, 21 bp, Artificial Sequence
  Description of Combined DNA/RNA Molecule: Synthetic oligonucleotide
  Description of Artificial Sequence: Synthetic oligonucleotide
aguauacugaagaaccucutt

SEQ ID NO: 673 - DNA, 21 bp, Artificial Sequence
  Description of Combined DNA/RNA Molecule: Synthetic oligonucleotide
  Description of Artificial Sequence: Synthetic oligonucleotide
agagguucuucaguauacutt

SEQ ID NO: 674 - DNA, 21 bp, Artificial Sequence
  Description of Combined DNA/RNA Molecule: Synthetic oligonucleotide
  Description of Artificial Sequence: Synthetic oligonucleotide
auauauaucagccgggcgctt

SEQ ID NO: 675 - DNA, 21 bp, Artificial Sequence
  Description of Combined DNA/RNA Molecule: Synthetic oligonucleotide
  Description of Artificial Sequence: Synthetic oligonucleotide
gcgcccggcugauauauautt

SEQ ID NO: 676 - DNA, 21 bp, Artificial Sequence
  Description of Combined DNA/RNA Molecule: Synthetic oligonucleotide
  Description of Artificial Sequence: Synthetic oligonucleotide
aaucuaacccuaguuguautt

SEQ ID NO: 677 - DNA, 21 bp, Artificial Sequence
  Description of Combined DNA/RNA Molecule: Synthetic oligonucleotide
  Description of Artificial Sequence: Synthetic oligonucleotide
auacaacuaggguuagauutt

SEQ ID NO: 678 - DNA, 21 bp, Artificial Sequence
  Description of Combined DNA/RNA Molecule: Synthetic oligonucleotide
  Description of Artificial Sequence: Synthetic oligonucleotide
cuaacccuaguuguauccctt

SEQ ID NO: 679 - DNA, 21 bp, Artificial Sequence
  Description of Combined DNA/RNA Molecule: Synthetic oligonucleotide
  Description of Artificial Sequence: Synthetic oligonucleotide
gggauacaacuaggguuagtt

SEQ ID NO: 680 - DNA, 21 bp, Artificial Sequence
  Description of Combined DNA/RNA Molecule: Synthetic oligonucleotide
  Description of Artificial Sequence: Synthetic oligonucleotide
cuaguuguaucccuccuuutt

SEQ ID NO: 681 - DNA, 21 bp, Artificial Sequence
  Description of Combined DNA/RNA Molecule: Synthetic oligonucleotide
  Description of Artificial Sequence: Synthetic oligonucleotide
aaaggagggauacaacuagtt

SEQ ID NO: 682 - DNA, 21 bp, Artificial Sequence
  Description of Combined DNA/RNA Molecule: Synthetic oligonucleotide
  Description of Artificial Sequence: Synthetic oligonucleotide
agacaucugacuaauggcutt

SEQ ID NO: 683 - DNA, 21 bp, Artificial Sequence
  Description of Combined DNA/RNA Molecule: Synthetic oligonucleotide
  Description of Artificial Sequence: Synthetic oligonucleotide
agccauuagucagaugucutt

SEQ ID NO: 684 - DNA, 21 bp, Artificial Sequence
  Description of Combined DNA/RNA Molecule: Synthetic oligonucleotide
  Description of Artificial Sequence: Synthetic oligonucleotide
gaagcucacaaugauuuaatt

SEQ ID NO: 685 - DNA, 21 bp, Artificial Sequence
  Description of Combined DNA/RNA Molecule: Synthetic oligonucleotide
  Description of Artificial Sequence: Synthetic oligonucleotide
uuaaaucauugugagcuuctt

SEQ ID NO: 686 - DNA, 21 bp, Artificial Sequence
  Description of Combined DNA/RNA Molecule: Synthetic oligonucleotide
  Description of Artificial Sequence: Synthetic oligonucleotide
acauguaucuuuuucucgatt

SEQ ID NO: 687 - DNA, 21 bp, Artificial Sequence
  Description of Combined DNA/RNA Molecule: Synthetic oligonucleotide
  Description of Artificial Sequence: Synthetic oligonucleotide
ucgagaaaaagauacaugutt

SEQ ID NO: 688 - DNA, 21 bp, Artificial Sequence
  Description of Combined DNA/RNA Molecule: Synthetic oligonucleotide
  Description of Artificial Sequence: Synthetic oligonucleotide
ucgauucaaaucuuaaccctt

SEQ ID NO: 689 - DNA, 21 bp, Artificial Sequence
  Description of Combined DNA/RNA Molecule: Synthetic oligonucleotide
  Description of Artificial Sequence: Synthetic oligonucleotide
ggguuaagauuugaaucgatt

SEQ ID NO: 690 - DNA, 21 bp, Artificial Sequence
  Description of Combined DNA/RNA Molecule: Synthetic oligonucleotide
  Description of Artificial Sequence: Synthetic oligonucleotide
ucuuaacccuuaggacucutt

SEQ ID NO: 691 - DNA, 21 bp, Artificial Sequence
  Description of Combined DNA/RNA Molecule: Synthetic oligonucleotide
  Description of Artificial Sequence: Synthetic oligonucleotide
agaguccuaaggguuaagatt

SEQ ID NO: 692 - DNA, 21 bp, Artificial Sequence
  Description of Combined DNA/RNA Molecule: Synthetic oligonucleotide
  Description of Artificial Sequence: Synthetic oligonucleotide
gcucacgaugaguuuagugtt

SEQ ID NO: 693 - DNA, 21 bp, Artificial Sequence
  Description of Combined DNA/RNA Molecule: Synthetic oligonucleotide
  Description of Artificial Sequence: Synthetic oligonucleotide
cacuaaacucaucgugagctt

SEQ ID NO: 694 - DNA, 21 bp, Artificial Sequence
  Description of Combined DNA/RNA Molecule: Synthetic oligonucleotide
  Description of Artificial Sequence: Synthetic oligonucleotide
cauaagcgauggauaauactt

SEQ ID NO: 695 - DNA, 21 bp, Artificial Sequence
  Description of Combined DNA/RNA Molecule: Synthetic oligonucleotide
  Description of Artificial Sequence: Synthetic oligonucleotide
guauuauccaucgcuuaugtt

SEQ ID NO: 696 - DNA, 21 bp, Artificial Sequence
  Description of Combined DNA/RNA Molecule: Synthetic oligonucleotide
  Description of Artificial Sequence: Synthetic oligonucleotide
auaagcgauggauaauacctt

SEQ ID NO: 697 - DNA, 21 bp, Artificial Sequence
  Description of Combined DNA/RNA Molecule: Synthetic oligonucleotide
  Description of Artificial Sequence: Synthetic oligonucleotide
gguauuauccaucgcuuautt

SEQ ID NO: 698 - DNA, 21 bp, Artificial Sequence
  Description of Combined DNA/RNA Molecule: Synthetic oligonucleotide
  Description of Artificial Sequence: Synthetic oligonucleotide
ccuaauaaacugcccucagtt

SEQ ID NO: 699 - DNA, 21 bp, Artificial Sequence
  Description of Combined DNA/RNA Molecule: Synthetic oligonucleotide
  Description of Artificial Sequence: Synthetic oligonucleotide
cugagggcaguuuauuaggtt

SEQ ID NO: 700 - DNA, 21 bp, Artificial Sequence
  Description of Combined DNA/RNA Molecule: Synthetic oligonucleotide
  Description of Artificial Sequence: Synthetic oligonucleotide
ucggaaaguugaacuuggutt

SEQ ID NO: 701 - DNA, 21 bp, Artificial Sequence
  Description of Combined DNA/RNA Molecule: Synthetic oligonucleotide
  Description of Artificial Sequence: Synthetic oligonucleotide
accaaguucaacuuuccgatt

SEQ ID NO: 702 - DNA, 21 bp, Artificial Sequence
  Description of Combined DNA/RNA Molecule: Synthetic oligonucleotide
  Description of Artificial Sequence: Synthetic oligonucleotide
gaaaacauuggccguucugtt

SEQ ID NO: 703 - DNA, 21 bp, Artificial Sequence
  Description of Combined DNA/RNA Molecule: Synthetic oligonucleotide
  Description of Artificial Sequence: Synthetic oligonucleotide
cagaacggccaauguuuuctt

SEQ ID NO: 704 - DNA, 21 bp, Artificial Sequence
  Description of Combined DNA/RNA Molecule: Synthetic oligonucleotide
  Description of Artificial Sequence: Synthetic oligonucleotide
aagacugaucuucuaaguutt

SEQ ID NO: 705 - DNA, 21 bp, Artificial Sequence
  Description of Combined DNA/RNA Molecule: Synthetic oligonucleotide
  Description of Artificial Sequence: Synthetic oligonucleotide
aacuuagaagaucagucuutt

SEQ ID NO: 706 - DNA, 21 bp, Artificial Sequence
  Description of Combined DNA/RNA Molecule: Synthetic oligonucleotide
  Description of Artificial Sequence: Synthetic oligonucleotide
gagcuuguuaaaaucggaatt

SEQ ID NO: 707 - DNA, 21 bp, Artificial Sequence
  Description of Combined DNA/RNA Molecule: Synthetic oligonucleotide
  Description of Artificial Sequence: Synthetic oligonucleotide
uuccgauuuuaacaagcuctt

SEQ ID NO: 708 - DNA, 21 bp, Artificial Sequence
  Description of Combined DNA/RNA Molecule: Synthetic oligonucleotide
  Description of Artificial Sequence: Synthetic oligonucleotide
acauuggccguucuggagctt

SEQ ID NO: 709 - DNA, 21 bp, Artificial Sequence
  Description of Combined DNA/RNA Molecule: Synthetic oligonucleotide
  Description of Artificial Sequence: Synthetic oligonucleotide
gcuccagaacggccaaugutt

SEQ ID NO: 710 - DNA, 21 bp, Artificial Sequence
  Description of Combined DNA/RNA Molecule: Synthetic oligonucleotide
  Description of Artificial Sequence: Synthetic oligonucleotide
aagaacaucuauaauugcatt

SEQ ID NO: 711 - DNA, 21 bp, Artificial Sequence
  Description of Combined DNA/RNA Molecule: Synthetic oligonucleotide
  Description of Artificial Sequence: Synthetic oligonucleotide
ugcaauuauagauguucuutt

SEQ ID NO: 712 - DNA, 21 bp, Artificial Sequence
  Description of Combined DNA/RNA Molecule: Synthetic oligonucleotide
  Description of Artificial Sequence: Synthetic oligonucleotide
aaaugugucuacucauguutt

SEQ ID NO: 713 - DNA, 21 bp, Artificial Sequence
  Description of Combined DNA/RNA Molecule: Synthetic oligonucleotide
  Description of Artificial Sequence: Synthetic oligonucleotide
aacaugaguagacacauuutt

SEQ ID NO: 714 - DNA, 21 bp, Artificial Sequence
  Description of Combined DNA/RNA Molecule: Synthetic oligonucleotide
  Description of Artificial Sequence: Synthetic oligonucleotide
ugucuacucauguuucucatt

SEQ ID NO: 715 - DNA, 21 bp, Artificial Sequence
  Description of Combined DNA/RNA Molecule: Synthetic oligonucleotide
  Description of Artificial Sequence: Synthetic oligonucleotide
ugagaaacaugaguagacatt

SEQ ID NO: 716 - DNA, 21 bp, Artificial Sequence
  Description of Combined DNA/RNA Molecule: Synthetic oligonucleotide
  Description of Artificial Sequence: Synthetic oligonucleotide
guauacuguguaacaaucutt

SEQ ID NO: 717 - DNA, 21 bp, Artificial Sequence
  Description of Combined DNA/RNA Molecule: Synthetic oligonucleotide
  Description of Artificial Sequence: Synthetic oligonucleotide
agauuguuacacaguauactt

SEQ ID NO: 718 - DNA, 21 bp, Artificial Sequence
  Description of Combined DNA/RNA Molecule: Synthetic oligonucleotide
  Description of Artificial Sequence: Synthetic oligonucleotide
uauacuguguaacaaucuatt

SEQ ID NO: 719 - DNA, 21 bp, Artificial Sequence
  Description of Combined DNA/RNA Molecule: Synthetic oligonucleotide
  Description of Artificial Sequence: Synthetic oligonucleotide
uagauuguuacacaguauatt

SEQ ID NO: 720 - DNA, 21 bp, Artificial Sequence
  Description of Combined DNA/RNA Molecule: Synthetic oligonucleotide
  Description of Artificial Sequence: Synthetic oligonucleotide
cuuaguaguguccaggaaatt

SEQ ID NO: 721 - DNA, 21 bp, Artificial Sequence
  Description of Combined DNA/RNA Molecule: Synthetic oligonucleotide
  Description of Artificial Sequence: Synthetic oligonucleotide
uuuccuggacacuacuaagtt

SEQ ID NO: 722 - DNA, 21 bp, Artificial Sequence
  Description of Combined DNA/RNA Molecule: Synthetic oligonucleotide
  Description of Artificial Sequence: Synthetic oligonucleotide
ucagauggacguaaggcagtt

SEQ ID NO: 723 - DNA, 21 bp, Artificial Sequence
  Description of Combined DNA/RNA Molecule: Synthetic oligonucleotide
  Description of Artificial Sequence: Synthetic oligonucleotide
cugccuuacguccaucugatt

SEQ ID NO: 724 - DNA, 21 bp, Artificial Sequence
  Description of Combined DNA/RNA Molecule: Synthetic oligonucleotide
  Description of Artificial Sequence: Synthetic oligonucleotide
agauaaauugauagcacaatt

SEQ ID NO: 725 - DNA, 21 bp, Artificial Sequence
  Description of Combined DNA/RNA Molecule: Synthetic oligonucleotide
  Description of Artificial Sequence: Synthetic oligonucleotide
uugugcuaucaauuuaucutt

SEQ ID NO: 726 - DNA, 21 bp, Artificial Sequence
  Description of Combined DNA/RNA Molecule: Synthetic oligonucleotide
  Description of Artificial Sequence: Synthetic oligonucleotide
caacagguacgacaccacatt

SEQ ID NO: 727 - DNA, 21 bp, Artificial Sequence
  Description of Combined DNA/RNA Molecule: Synthetic oligonucleotide
  Description of Artificial Sequence: Synthetic oligonucleotide
uguggugucguaccuguugtt

SEQ ID NO: 728 - DNA, 21 bp, Artificial Sequence
  Description of Combined DNA/RNA Molecule: Synthetic oligonucleotide
  Description of Artificial Sequence: Synthetic oligonucleotide
ugcaauguaaauacguauutt

SEQ ID NO: 729 - DNA, 21 bp, Artificial Sequence
  Description of Combined DNA/RNA Molecule: Synthetic oligonucleotide
  Description of Artificial Sequence: Synthetic oligonucleotide
aauacguauuuacauugcatt

SEQ ID NO: 730 - DNA, 21 bp, Artificial Sequence
  Description of Combined DNA/RNA Molecule: Synthetic oligonucleotide
  Description of Artificial Sequence: Synthetic oligonucleotide
agucagaauuuuaucuagatt

SEQ ID NO: 731 - DNA, 21 bp, Artificial Sequence
  Description of Combined DNA/RNA Molecule: Synthetic oligonucleotide
  Description of Artificial Sequence: Synthetic oligonucleotide
ucuagauaaaauucugacutt

SEQ ID NO: 732 - DNA, 21 bp, Artificial Sequence
  Description of Combined DNA/RNA Molecule: Synthetic oligonucleotide
  Description of Artificial Sequence: Synthetic oligonucleotide
cuagaaaucuuuuaacacctt

SEQ ID NO: 733 - DNA, 21 bp, Artificial Sequence
  Description of Combined DNA/RNA Molecule: Synthetic oligonucleotide
  Description of Artificial Sequence: Synthetic oligonucleotide
gguguuaaaagauuucuagtt

SEQ ID NO: 734 - DNA, 21 bp, Artificial Sequence
  Description of Combined DNA/RNA Molecule: Synthetic oligonucleotide
  Description of Artificial Sequence: Synthetic oligonucleotide
aauaaaucuaacccuaguutt

SEQ ID NO: 735 - DNA, 21 bp, Artificial Sequence
  Description of Combined DNA/RNA Molecule: Synthetic oligonucleotide
  Description of Artificial Sequence: Synthetic oligonucleotide
aacuaggguuagauuuauutt

SEQ ID NO: 736 - DNA, 21 bp, Artificial Sequence
  Description of Combined DNA/RNA Molecule: Synthetic oligonucleotide
  Description of Artificial Sequence: Synthetic oligonucleotide
aauuuucugcucacgaugatt

SEQ ID NO: 737 - DNA, 21 bp, Artificial Sequence
  Description of Combined DNA/RNA Molecule: Synthetic oligonucleotide
  Description of Artificial Sequence: Synthetic oligonucleotide
ucaucgugagcagaaaauutt

SEQ ID NO: 738 - DNA, 21 bp, Artificial Sequence
  Description of Combined DNA/RNA Molecule: Synthetic oligonucleotide
  Description of Artificial Sequence: Synthetic oligonucleotide
gcccucaguaaauccauggtt

SEQ ID NO: 739 - DNA, 21 bp, Artificial Sequence
  Description of Combined DNA/RNA Molecule: Synthetic oligonucleotide
  Description of Artificial Sequence: Synthetic oligonucleotide
ccauggauuuacugagggctt

SEQ ID NO: 740 - DNA, 21 bp, Artificial Sequence
  Description of Combined DNA/RNA Molecule: Synthetic oligonucleotide
  Description of Artificial Sequence: Synthetic oligonucleotide
acguuuaaaacgagaucuutt

SEQ ID NO: 741 - DNA, 21 bp, Artificial Sequence
  Description of Combined DNA/RNA Molecule: Synthetic oligonucleotide
  Description of Artificial Sequence: Synthetic oligonucleotide
aagaucucguuuuaaacgutt

SEQ ID NO: 742 - DNA, 21 bp, Artificial Sequence
  Description of Combined DNA/RNA Molecule: Synthetic oligonucleotide
  Description of Artificial Sequence: Synthetic oligonucleotide
aggagauagaacguuuaaatt

SEQ ID NO: 743 - DNA, 21 bp, Artificial Sequence
  Description of Combined DNA/RNA Molecule: Synthetic oligonucleotide
  Description of Artificial Sequence: Synthetic oligonucleotide
uuuaaacguucuaucuccutt

SEQ ID NO: 744 - DNA, 21 bp, Artificial Sequence
  Description of Combined DNA/RNA Molecule: Synthetic oligonucleotide
  Description of Artificial Sequence: Synthetic oligonucleotide
gaccgucauggcgucgcagtt

SEQ ID NO: 745 - DNA, 21 bp, Artificial Sequence
  Description of Combined DNA/RNA Molecule: Synthetic oligonucleotide
  Description of Artificial Sequence: Synthetic oligonucleotide
cugcgacgccaugacgguctt

SEQ ID NO: 746 - DNA, 21 bp, Artificial Sequence
  Description of Combined DNA/RNA Molecule: Synthetic oligonucleotide
  Description of Artificial Sequence: Synthetic oligonucleotide
accgucauggcgucgcagctt

SEQ ID NO: 747 - DNA, 21 bp, Artificial Sequence
  Description of Combined DNA/RNA Molecule: Synthetic oligonucleotide
  Description of Artificial Sequence: Synthetic oligonucleotide
gcugcgacgccaugacggutt

SEQ ID NO: 748 - DNA, 21 bp, Artificial Sequence
  Description of Combined DNA/RNA Molecule: Synthetic oligonucleotide
  Description of Artificial Sequence: Synthetic oligonucleotide
gaacguuuaaaacgagauctt

SEQ ID NO: 749 - DNA, 21 bp, Artificial Sequence
  Description of Combined DNA/RNA Molecule: Synthetic oligonucleotide
  Description of Artificial Sequence: Synthetic oligonucleotide
gaucucguuuuaaacguuctt

SEQ ID NO: 750 - DNA, 21 bp, Artificial Sequence
  Description of Combined DNA/RNA Molecule: Synthetic oligonucleotide
  Description of Artificial Sequence: Synthetic oligonucleotide
uugagcuuaacauagguaatt

SEQ ID NO: 751 - DNA, 21 bp, Artificial Sequence
  Description of Combined DNA/RNA Molecule: Synthetic oligonucleotide
  Description of Artificial Sequence: Synthetic oligonucleotide
uuaccuauguuaagcucaatt

SEQ ID NO: 752 - DNA, 21 bp, Artificial Sequence
  Description of Combined DNA/RNA Molecule: Synthetic oligonucleotide
  Description of Artificial Sequence: Synthetic oligonucleotide
acuaaauugaucucguagatt

SEQ ID NO: 753 - DNA, 21 bp, Artificial Sequence
  Description of Combined DNA/RNA Molecule: Synthetic oligonucleotide
  Description of Artificial Sequence: Synthetic oligonucleotide
ucuacgagaucaauuuagutt

SEQ ID NO: 754 - DNA, 21 bp, Artificial Sequence
  Description of Combined DNA/RNA Molecule: Synthetic oligonucleotide
  Description of Artificial Sequence: Synthetic oligonucleotide
ucguagaauuaucuuaauatt

SEQ ID NO: 755 - DNA, 21 bp, Artificial Sequence
  Description of Combined DNA/RNA Molecule: Synthetic oligonucleotide
  Description of Artificial Sequence: Synthetic oligonucleotide
uauuaagauaauucuacgatt

SEQ ID NO: 756 - DNA, 21 bp, Artificial Sequence
  Description of Combined DNA/RNA Molecule: Synthetic oligonucleotide
  Description of Artificial Sequence: Synthetic oligonucleotide
ggagauagaacguuuaaaatt

SEQ ID NO: 757 - DNA, 21 bp, Artificial Sequence
  Description of Combined DNA/RNA Molecule: Synthetic oligonucleotide
  Description of Artificial Sequence: Synthetic oligonucleotide
uuuuaaacguucuaucucctt

SEQ ID NO: 758 - DNA, 21 bp, Artificial Sequence
  Description of Combined DNA/RNA Molecule: Synthetic oligonucleotide
  Description of Artificial Sequence: Synthetic oligonucleotide
acaacuuauuggagguugutt

SEQ ID NO: 759 - DNA, 21 bp, Artificial Sequence
  Description of Combined DNA/RNA Molecule: Synthetic oligonucleotide
  Description of Artificial Sequence: Synthetic oligonucleotide
acaaccuccaauaaguugutt

SEQ ID NO: 760 - DNA, 21 bp, Artificial Sequence
  Description of Combined DNA/RNA Molecule: Synthetic oligonucleotide
  Description of Artificial Sequence: Synthetic oligonucleotide
ugagcuuaacauagguaaatt

SEQ ID NO: 761 - DNA, 21 bp, Artificial Sequence
  Description of Combined DNA/RNA Molecule: Synthetic oligonucleotide
  Description of Artificial Sequence: Synthetic oligonucleotide
uuuaccuauguuaagcucatt

SEQ ID NO: 762 - DNA, 21 bp, Artificial Sequence
  Description of Combined DNA/RNA Molecule: Synthetic oligonucleotide
  Description of Artificial Sequence: Synthetic oligonucleotide
aucucguagaauuaucuuatt

SEQ ID NO: 763 - DNA, 21 bp, Artificial Sequence
  Description of Combined DNA/RNA Molecule: Synthetic oligonucleotide
  Description of Artificial Sequence: Synthetic oligonucleotide
uaagauaauucuacgagautt

SEQ ID NO: 764 - DNA, 21 bp, Artificial Sequence
  Description of Combined DNA/RNA Molecule: Synthetic oligonucleotide
  Description of Artificial Sequence: Synthetic oligonucleotide
cugcgugcagucgguccuctt

SEQ ID NO: 765 - DNA, 21 bp, Artificial Sequence
  Description of Combined DNA/RNA Molecule: Synthetic oligonucleotide
  Description of Artificial Sequence: Synthetic oligonucleotide
gaggaccgacugcacgcagtt

SEQ ID NO: 766 - DNA, 21 bp, Artificial Sequence
  Description of Combined DNA/RNA Molecule: Synthetic oligonucleotide
  Description of Artificial Sequence: Synthetic oligonucleotide
cacgcagcgcccgagaguatt

SEQ ID NO: 767 - DNA, 21 bp, Artificial Sequence
  Description of Combined DNA/RNA Molecule: Synthetic oligonucleotide
  Description of Artificial Sequence: Synthetic oligonucleotide
uacucucgggcgcugcgugtt

SEQ ID NO: 768 - DNA, 21 bp, Artificial Sequence
  Description of Combined DNA/RNA Molecule: Synthetic oligonucleotide
  Description of Artificial Sequence: Synthetic oligonucleotide
aguaccagggagacuccggtt

SEQ ID NO: 769 - DNA, 21 bp, Artificial Sequence
  Description of Combined DNA/RNA Molecule: Synthetic oligonucleotide
  Description of Artificial Sequence: Synthetic oligonucleotide
ccggagucucccugguacutt

SEQ ID NO: 770 - DNA, 21 bp, Artificial Sequence
  Description of Combined DNA/RNA Molecule: Synthetic oligonucleotide
  Description of Artificial Sequence: Synthetic oligonucleotide
acggaggagauagaacguutt

SEQ ID NO: 771 - DNA, 21 bp, Artificial Sequence
  Description of Combined DNA/RNA Molecule: Synthetic oligonucleotide
  Description of Artificial Sequence: Synthetic oligonucleotide
aacguucuaucuccuccgutt

SEQ ID NO: 772 - DNA, 21 bp, Artificial Sequence
  Description of Combined DNA/RNA Molecule: Synthetic oligonucleotide
  Description of Artificial Sequence: Synthetic oligonucleotide
agaacguuuaaaacgagautt

SEQ ID NO: 773 - DNA, 21 bp, Artificial Sequence
  Description of Combined DNA/RNA Molecule: Synthetic oligonucleotide
  Description of Artificial Sequence: Synthetic oligonucleotide
aucucguuuuaaacguucutt

SEQ ID NO: 774 - DNA, 21 bp, Artificial Sequence
  Description of Combined DNA/RNA Molecule: Synthetic oligonucleotide
  Description of Artificial Sequence: Synthetic oligonucleotide
aacguuuaaaacgagaucutt

SEQ ID NO: 775 - DNA, 21 bp, Artificial Sequence
  Description of Combined DNA/RNA Molecule: Synthetic oligonucleotide
  Description of Artificial Sequence: Synthetic oligonucleotide
agaucucguuuuaaacguutt

SEQ ID NO: 776 - DNA, 21 bp, Artificial Sequence
  Description of Combined DNA/RNA Molecule: Synthetic oligonucleotide
  Description of Artificial Sequence: Synthetic oligonucleotide
agcuugagcuuaacauaggtt

SEQ ID NO: 777 - DNA, 21 bp, Artificial Sequence
  Description of Combined DNA/RNA Molecule: Synthetic oligonucleotide
  Description of Artificial Sequence: Synthetic oligonucleotide
ccuauguuaagcucaagcutt

SEQ ID NO: 778 - DNA, 21 bp, Artificial Sequence
  Description of Combined DNA/RNA Molecule: Synthetic oligonucleotide
  Description of Artificial Sequence: Synthetic oligonucleotide
agcuuaacauagguaaauatt

SEQ ID NO: 779 - DNA, 21 bp, Artificial Sequence
  Description of Combined DNA/RNA Molecule: Synthetic oligonucleotide
  Description of Artificial Sequence: Synthetic oligonucleotide
uauuuaccuauguuaagcutt

SEQ ID NO: 780 - DNA, 21 bp, Artificial Sequence
  Description of Combined DNA/RNA Molecule: Synthetic oligonucleotide
  Description of Artificial Sequence: Synthetic oligonucleotide
uagagcuacaaaaccuauctt

SEQ ID NO: 781 - DNA, 21 bp, Artificial Sequence
  Description of Combined DNA/RNA Molecule: Synthetic oligonucleotide
  Description of Artificial Sequence: Synthetic oligonucleotide
gauagguuuuguagcucuatt

SEQ ID NO: 782 - DNA, 21 bp, Artificial Sequence
  Description of Combined DNA/RNA Molecule: Synthetic oligonucleotide
  Description of Artificial Sequence: Synthetic oligonucleotide
uaguuguaucccuccuuuatt

SEQ ID NO: 783 - DNA, 21 bp, Artificial Sequence
  Description of Combined DNA/RNA Molecule: Synthetic oligonucleotide
  Description of Artificial Sequence: Synthetic oligonucleotide
uaaaggagggauacaacuatt

SEQ ID NO: 784 - DNA, 21 bp, Artificial Sequence
  Description of Combined DNA/RNA Molecule: Synthetic oligonucleotide
  Description of Artificial Sequence: Synthetic oligonucleotide
accacccagacaucugacutt

SEQ ID NO: 785 - DNA, 21 bp, Artificial Sequence
  Description of Combined DNA/RNA Molecule: Synthetic oligonucleotide
  Description of Artificial Sequence: Synthetic oligonucleotide
agucagaugucuggguggutt

SEQ ID NO: 786 - DNA, 21 bp, Artificial Sequence
  Description of Combined DNA/RNA Molecule: Synthetic oligonucleotide
  Description of Artificial Sequence: Synthetic oligonucleotide
agaaacuaaauugaucucgtt

SEQ ID NO: 787 - DNA, 21 bp, Artificial Sequence
  Description of Combined DNA/RNA Molecule: Synthetic oligonucleotide
  Description of Artificial Sequence: Synthetic oligonucleotide
cgagaucaauuuaguuucutt

SEQ ID NO: 788 - DNA, 21 bp, Artificial Sequence
  Description of Combined DNA/RNA Molecule: Synthetic oligonucleotide
  Description of Artificial Sequence: Synthetic oligonucleotide
ucucguagaauuaucuuaatt

SEQ ID NO: 789 - DNA, 21 bp, Artificial Sequence
  Description of Combined DNA/RNA Molecule: Synthetic oligonucleotide
  Description of Artificial Sequence: Synthetic oligonucleotide
uuaagauaauucuacgagatt

SEQ ID NO: 790 - DNA, 21 bp, Artificial Sequence
  Description of Combined DNA/RNA Molecule: Synthetic oligonucleotide
  Description of Artificial Sequence: Synthetic oligonucleotide
caacuuauuggagguuguatt

SEQ ID NO: 791 - DNA, 21 bp, Artificial Sequence
  Description of Combined DNA/RNA Molecule: Synthetic oligonucleotide
  Description of Artificial Sequence: Synthetic oligonucleotide
uacaaccuccaauaaguugtt

SEQ ID NO: 792 - DNA, 21 bp, Artificial Sequence
  Description of Combined DNA/RNA Molecule: Synthetic oligonucleotide
  Description of Artificial Sequence: Synthetic oligonucleotide
uuguaucccuccuuuaagutt

SEQ ID NO: 793 - DNA, 21 bp, Artificial Sequence
  Description of Combined DNA/RNA Molecule: Synthetic oligonucleotide
  Description of Artificial Sequence: Synthetic oligonucleotide
acuuaaaggagggauacaatt

SEQ ID NO: 794 - DNA, 21 bp, Artificial Sequence
  Description of Combined DNA/RNA Molecule: Synthetic oligonucleotide
  Description of Artificial Sequence: Synthetic oligonucleotide
ucacaacuuauuggagguutt

SEQ ID NO: 795 - DNA, 21 bp, Artificial Sequence
  Description of Combined DNA/RNA Molecule: Synthetic oligonucleotide
  Description of Artificial Sequence: Synthetic oligonucleotide
aaccuccaauaaguugugatt

SEQ ID NO: 796 - DNA, 21 bp, Artificial Sequence
  Description of Combined DNA/RNA Molecule: Synthetic oligonucleotide
  Description of Artificial Sequence: Synthetic oligonucleotide
agaacuguacucuucucagtt

SEQ ID NO: 797 - DNA, 21 bp, Artificial Sequence
  Description of Combined DNA/RNA Molecule: Synthetic oligonucleotide
  Description of Artificial Sequence: Synthetic oligonucleotide
cugagaagaguacaguucutt

SEQ ID NO: 798 - DNA, 21 bp, Artificial Sequence
  Description of Combined DNA/RNA Molecule: Synthetic oligonucleotide
  Description of Artificial Sequence: Synthetic oligonucleotide
gagcuuaacauagguaaautt

SEQ ID NO: 799 - DNA, 21 bp, Artificial Sequence
  Description of Combined DNA/RNA Molecule: Synthetic oligonucleotide
  Description of Artificial Sequence: Synthetic oligonucleotide
auuuaccuauguuaagcuctt

SEQ ID NO: 800 - DNA, 21 bp, Artificial Sequence
  Description of Combined DNA/RNA Molecule: Synthetic oligonucleotide
  Description of Artificial Sequence: Synthetic oligonucleotide
caccaacaucuguccuuagtt

SEQ ID NO: 801 - DNA, 21 bp, Artificial Sequence
  Description of Combined DNA/RNA Molecule: Synthetic oligonucleotide
  Description of Artificial Sequence: Synthetic oligonucleotide
cuaaggacagauguuggugtt

SEQ ID NO: 802 - DNA, 21 bp, Artificial Sequence
  Description of Combined DNA/RNA Molecule: Synthetic oligonucleotide
  Description of Artificial Sequence: Synthetic oligonucleotide
aaagcccacuuuagaguautt

SEQ ID NO: 803 - DNA, 21 bp, Artificial Sequence
  Description of Combined DNA/RNA Molecule: Synthetic oligonucleotide
  Description of Artificial Sequence: Synthetic oligonucleotide
auacucuaaagugggcuuutt

SEQ ID NO: 804 - DNA, 21 bp, Artificial Sequence
  Description of Combined DNA/RNA Molecule: Synthetic oligonucleotide
  Description of Artificial Sequence: Synthetic oligonucleotide
aagcccacuuuagaguauatt

SEQ ID NO: 805 - DNA, 21 bp, Artificial Sequence
  Description of Combined DNA/RNA Molecule: Synthetic oligonucleotide
  Description of Artificial Sequence: Synthetic oligonucleotide
uauacucuaaagugggcuutt

SEQ ID NO: 806 - DNA, 21 bp, Artificial Sequence
  Description of Combined DNA/RNA Molecule: Synthetic oligonucleotide
  Description of Artificial Sequence: Synthetic oligonucleotide
gaccuuauuugguaaucugtt

SEQ ID NO: 807 - DNA, 21 bp, Artificial Sequence
  Description of Combined DNA/RNA Molecule: Synthetic oligonucleotide
  Description of Artificial Sequence: Synthetic oligonucleotide
cagauuaccaaauaagguctt

SEQ ID NO: 808 - DNA, 21 bp, Artificial Sequence
  Description of Combined DNA/RNA Molecule: Synthetic oligonucleotide
  Description of Artificial Sequence: Synthetic oligonucleotide
gauuaauguacucaagacutt

SEQ ID NO: 809 - DNA, 21 bp, Artificial Sequence
  Description of Combined DNA/RNA Molecule: Synthetic oligonucleotide
  Description of Artificial Sequence: Synthetic oligonucleotide
agucuugaguacauuaauctt

SEQ ID NO: 810 - DNA, 21 bp, Artificial Sequence
  Description of Combined DNA/RNA Molecule: Synthetic oligonucleotide
  Description of Artificial Sequence: Synthetic oligonucleotide
cuuuaagaggccuaacucatt

SEQ ID NO: 811 - DNA, 21 bp, Artificial Sequence
  Description of Combined DNA/RNA Molecule: Synthetic oligonucleotide
  Description of Artificial Sequence: Synthetic oligonucleotide
ugaguuaggccucuuaaagtt

SEQ ID NO: 812 - DNA, 21 bp, Artificial Sequence
  Description of Combined DNA/RNA Molecule: Synthetic oligonucleotide
  Description of Artificial Sequence: Synthetic oligonucleotide
uuaaaccaaacccuauugatt

SEQ ID NO: 813 - DNA, 21 bp, Artificial Sequence
  Description of Combined DNA/RNA Molecule: Synthetic oligonucleotide
  Description of Artificial Sequence: Synthetic oligonucleotide
ucaauaggguuugguuuaatt

SEQ ID NO: 814 - DNA, 21 bp, Artificial Sequence
  Description of Combined DNA/RNA Molecule: Synthetic oligonucleotide
  Description of Artificial Sequence: Synthetic oligonucleotide
ucuguuggagaucuauaautt

SEQ ID NO: 815 - DNA, 21 bp, Artificial Sequence
  Description of Combined DNA/RNA Molecule: Synthetic oligonucleotide
  Description of Artificial Sequence: Synthetic oligonucleotide
auuauagaucuccaacagatt

SEQ ID NO: 816 - DNA, 21 bp, Artificial Sequence
  Description of Combined DNA/RNA Molecule: Synthetic oligonucleotide
  Description of Artificial Sequence: Synthetic oligonucleotide
cugauguuucugagagacutt

SEQ ID NO: 817 - DNA, 21 bp, Artificial Sequence
  Description of Combined DNA/RNA Molecule: Synthetic oligonucleotide
  Description of Artificial Sequence: Synthetic oligonucleotide
agucucucagaaacaucagtt

SEQ ID NO: 818 - DNA, 21 bp, Artificial Sequence
  Description of Combined DNA/RNA Molecule: Synthetic oligonucleotide
  Description of Artificial Sequence: Synthetic oligonucleotide
gcauacucuagucguuccctt

SEQ ID NO: 819 - DNA, 21 bp, Artificial Sequence
  Description of Combined DNA/RNA Molecule: Synthetic oligonucleotide
  Description of Artificial Sequence: Synthetic oligonucleotide
gggaacgacuagaguaugctt

SEQ ID NO: 820 - DNA, 21 bp, Artificial Sequence
  Description of Combined DNA/RNA Molecule: Synthetic oligonucleotide
  Description of Artificial Sequence: Synthetic oligonucleotide
guuccuuaucgagaaucuatt

SEQ ID NO: 821 - DNA, 21 bp, Artificial Sequence
  Description of Combined DNA/RNA Molecule: Synthetic oligonucleotide
  Description of Artificial Sequence: Synthetic oligonucleotide
uagauucucgauaaggaactt

SEQ ID NO: 822 - DNA, 21 bp, Artificial Sequence
  Description of Combined DNA/RNA Molecule: Synthetic oligonucleotide
  Description of Artificial Sequence: Synthetic oligonucleotide
gcacuuggaucucucacautt

SEQ ID NO: 823 - DNA, 21 bp, Artificial Sequence
  Description of Combined DNA/RNA Molecule: Synthetic oligonucleotide
  Description of Artificial Sequence: Synthetic oligonucleotide
augugagagauccaagugctt

SEQ ID NO: 824 - DNA, 21 bp, Artificial Sequence
  Description of Combined DNA/RNA Molecule: Synthetic oligonucleotide
  Description of Artificial Sequence: Synthetic oligonucleotide
aaaaaaggaacuagauggctt

SEQ ID NO: 825 - DNA, 21 bp, Artificial Sequence
  Description of Combined DNA/RNA Molecule: Synthetic oligonucleotide
  Description of Artificial Sequence: Synthetic oligonucleotide
gccaucuaguuccuuuuuutt

SEQ ID NO: 826 - DNA, 21 bp, Artificial Sequence
  Description of Combined DNA/RNA Molecule: Synthetic oligonucleotide
  Description of Artificial Sequence: Synthetic oligonucleotide
agagcagauuaccucugcgtt

SEQ ID NO: 827 - DNA, 21 bp, Artificial Sequence
  Description of Combined DNA/RNA Molecule: Synthetic oligonucleotide
  Description of Artificial Sequence: Synthetic oligonucleotide
cgcagagguaaucugcucutt

SEQ ID NO: 828 - DNA, 21 bp, Artificial Sequence
  Description of Combined DNA/RNA Molecule: Synthetic oligonucleotide
  Description of Artificial Sequence: Synthetic oligonucleotide
agcagauuaccucugcgagtt

SEQ ID NO: 829 - DNA, 21 bp, Artificial Sequence
  Description of Combined DNA/RNA Molecule: Synthetic oligonucleotide
  Description of Artificial Sequence: Synthetic oligonucleotide
cucgcagagguaaucugcutt

SEQ ID NO: 830 - DNA, 21 bp, Artificial Sequence
  Description of Combined DNA/RNA Molecule: Synthetic oligonucleotide
  Description of Artificial Sequence: Synthetic oligonucleotide
cccugacagaguucacaaatt

SEQ ID NO: 831 - DNA, 21 bp, Artificial Sequence
  Description of Combined DNA/RNA Molecule: Synthetic oligonucleotide
  Description of Artificial Sequence: Synthetic oligonucleotide
uuugugaacucugucagggtt

SEQ ID NO: 832 - DNA, 21 bp, Artificial Sequence
  Description of Combined DNA/RNA Molecule: Synthetic oligonucleotide
  Description of Artificial Sequence: Synthetic oligonucleotide
guuuaccgaaguguuguuutt

SEQ ID NO: 833 - DNA, 21 bp, Artificial Sequence
  Description of Combined DNA/RNA Molecule: Synthetic oligonucleotide
  Description of Artificial Sequence: Synthetic oligonucleotide
aaacaacacuucgguaaactt

SEQ ID NO: 834 - DNA, 21 bp, Artificial Sequence
  Description of Combined DNA/RNA Molecule: Synthetic oligonucleotide
  Description of Artificial Sequence: Synthetic oligonucleotide
uuacaguacacaacaaggatt

SEQ ID NO: 835 - DNA, 21 bp, Artificial Sequence
  Description of Combined DNA/RNA Molecule: Synthetic oligonucleotide
  Description of Artificial Sequence: Synthetic oligonucleotide
uccuuguuguguacuguaatt

SEQ ID NO: 836 - DNA, 21 bp, Artificial Sequence
  Description of Combined DNA/RNA Molecule: Synthetic oligonucleotide
  Description of Artificial Sequence: Synthetic oligonucleotide
acuggaucguaagaaggcatt

SEQ ID NO: 837 - DNA, 21 bp, Artificial Sequence
  Description of Combined DNA/RNA Molecule: Synthetic oligonucleotide
  Description of Artificial Sequence: Synthetic oligonucleotide
ugccuucuuacgauccagutt

SEQ ID NO: 838 - DNA, 21 bp, Artificial Sequence
  Description of Combined DNA/RNA Molecule: Synthetic oligonucleotide
  Description of Artificial Sequence: Synthetic oligonucleotide
gagcagauuaccucugcgatt

SEQ ID NO: 839 - DNA, 21 bp, Artificial Sequence
  Description of Combined DNA/RNA Molecule: Synthetic oligonucleotide
  Description of Artificial Sequence: Synthetic oligonucleotide
ucgcagagguaaucugcuctt

SEQ ID NO: 840 - DNA, 21 bp, Artificial Sequence
  Description of Combined DNA/RNA Molecule: Synthetic oligonucleotide
  Description of Artificial Sequence: Synthetic oligonucleotide
aaaagaaguuaguguacgatt

SEQ ID NO: 841 - DNA, 21 bp, Artificial Sequence
  Description of Combined DNA/RNA Molecule: Synthetic oligonucleotide
  Description of Artificial Sequence: Synthetic oligonucleotide
ucguacacuaacuucuuuutt

SEQ ID NO: 842 - DNA, 21 bp, Artificial Sequence
  Description of Combined DNA/RNA Molecule: Synthetic oligonucleotide
  Description of Artificial Sequence: Synthetic oligonucleotide
gaccauuuaauuuggcagatt

SEQ ID NO: 843 - DNA, 21 bp, Artificial Sequence
  Description of Combined DNA/RNA Molecule: Synthetic oligonucleotide
  Description of Artificial Sequence: Synthetic oligonucleotide
ucugccaaauuaaaugguctt

SEQ ID NO: 844 - DNA, 21 bp, Artificial Sequence
  Description of Combined DNA/RNA Molecule: Synthetic oligonucleotide
  Description of Artificial Sequence: Synthetic oligonucleotide
gagaggagugauaauuaaatt

SEQ ID NO: 845 - DNA, 21 bp, Artificial Sequence
  Description of Combined DNA/RNA Molecule: Synthetic oligonucleotide
  Description of Artificial Sequence: Synthetic oligonucleotide
uuuaauuaucacuccucuctt

SEQ ID NO: 846 - DNA, 21 bp, Artificial Sequence
  Description of Combined DNA/RNA Molecule: Synthetic oligonucleotide
  Description of Artificial Sequence: Synthetic oligonucleotide
cuggaggauuggcugacaatt

SEQ ID NO: 847 - DNA, 21 bp, Artificial Sequence
  Description of Combined DNA/RNA Molecule: Synthetic oligonucleotide
  Description of Artificial Sequence: Synthetic oligonucleotide
uugucagccaauccuccagtt

SEQ ID NO: 848 - DNA, 21 bp, Artificial Sequence
  Description of Combined DNA/RNA Molecule: Synthetic oligonucleotide
  Description of Artificial Sequence: Synthetic oligonucleotide
cucuagucguucccacucatt

SEQ ID NO: 849 - DNA, 21 bp, Artificial Sequence
  Description of Combined DNA/RNA Molecule: Synthetic oligonucleotide
  Description of Artificial Sequence: Synthetic oligonucleotide
ugagugggaacgacuagagtt

SEQ ID NO: 850 - DNA, 21 bp, Artificial Sequence
  Description of Combined DNA/RNA Molecule: Synthetic oligonucleotide
  Description of Artificial Sequence: Synthetic oligonucleotide
gauaccauuacuacaguagtt

SEQ ID NO: 851 - DNA, 21 bp, Artificial Sequence
  Description of Combined DNA/RNA Molecule: Synthetic oligonucleotide
  Description of Artificial Sequence: Synthetic oligonucleotide
cuacuguaguaaugguauctt

SEQ ID NO: 852 - DNA, 21 bp, Artificial Sequence
  Description of Combined DNA/RNA Molecule: Synthetic oligonucleotide
  Description of Artificial Sequence: Synthetic oligonucleotide
uucgucugcgaagaagaaatt

SEQ ID NO: 853 - DNA, 21 bp, Artificial Sequence
  Description of Combined DNA/RNA Molecule: Synthetic oligonucleotide
  Description of Artificial Sequence: Synthetic oligonucleotide
uuucuucuucgcagacgaatt

SEQ ID NO: 854 - DNA, 21 bp, Artificial Sequence
  Description of Combined DNA/RNA Molecule: Synthetic oligonucleotide
  Description of Artificial Sequence: Synthetic oligonucleotide
gaaaagaaguuaguguacgtt

SEQ ID NO: 855 - DNA, 21 bp, Artificial Sequence
  Description of Combined DNA/RNA Molecule: Synthetic oligonucleotide
  Description of Artificial Sequence: Synthetic oligonucleotide
cguacacuaacuucuuuuctt

SEQ ID NO: 856 - DNA, 21 bp, Artificial Sequence
  Description of Combined DNA/RNA Molecule: Synthetic oligonucleotide
  Description of Artificial Sequence: Synthetic oligonucleotide
ugauguuuaccgaaguguutt

SEQ ID NO: 857 - DNA, 21 bp, Artificial Sequence
  Description of Combined DNA/RNA Molecule: Synthetic oligonucleotide
  Description of Artificial Sequence: Synthetic oligonucleotide
aacacuucgguaaacaucatt

SEQ ID NO: 858 - DNA, 21 bp, Artificial Sequence
  Description of Combined DNA/RNA Molecule: Synthetic oligonucleotide
  Description of Artificial Sequence: Synthetic oligonucleotide
uguuuguccaauucuggautt

SEQ ID NO: 859 - DNA, 21 bp, Artificial Sequence
  Description of Combined DNA/RNA Molecule: Synthetic oligonucleotide
  Description of Artificial Sequence: Synthetic oligonucleotide
auccagaauuggacaaacatt

SEQ ID NO: 860 - DNA, 21 bp, Artificial Sequence
  Description of Combined DNA/RNA Molecule: Synthetic oligonucleotide
  Description of Artificial Sequence: Synthetic oligonucleotide
augaagaguauaccugggatt

SEQ ID NO: 861 - DNA, 21 bp, Artificial Sequence
  Description of Combined DNA/RNA Molecule: Synthetic oligonucleotide
  Description of Artificial Sequence: Synthetic oligonucleotide
ucccagguauacucuucautt

SEQ ID NO: 862 - DNA, 21 bp, Artificial Sequence
  Description of Combined DNA/RNA Molecule: Synthetic oligonucleotide
  Description of Artificial Sequence: Synthetic oligonucleotide
gcuacucugaugaaugcautt

SEQ ID NO: 863 - DNA, 21 bp, Artificial Sequence
  Description of Combined DNA/RNA Molecule: Synthetic oligonucleotide
  Description of Artificial Sequence: Synthetic oligonucleotide
augcauucaucagaguagctt

SEQ ID NO: 864 - DNA, 21 bp, Artificial Sequence
  Description of Combined DNA/RNA Molecule: Synthetic oligonucleotide
  Description of Artificial Sequence: Synthetic oligonucleotide
gcccuuguagaaagaacactt

SEQ ID NO: 865 - DNA, 21 bp, Artificial Sequence
  Description of Combined DNA/RNA Molecule: Synthetic oligonucleotide
  Description of Artificial Sequence: Synthetic oligonucleotide
guguucuuucuacaagggctt

SEQ ID NO: 866 - DNA, 21 bp, Artificial Sequence
  Description of Combined DNA/RNA Molecule: Synthetic oligonucleotide
  Description of Artificial Sequence: Synthetic oligonucleotide
ucauguuccuuaucgagaatt

SEQ ID NO: 867 - DNA, 21 bp, Artificial Sequence
  Description of Combined DNA/RNA Molecule: Synthetic oligonucleotide
  Description of Artificial Sequence: Synthetic oligonucleotide
uucucgauaaggaacaugatt

SEQ ID NO: 868 - DNA, 21 bp, Artificial Sequence
  Description of Combined DNA/RNA Molecule: Synthetic oligonucleotide
  Description of Artificial Sequence: Synthetic oligonucleotide
gaauaggguuacagaguugtt

SEQ ID NO: 869 - DNA, 21 bp, Artificial Sequence
  Description of Combined DNA/RNA Molecule: Synthetic oligonucleotide
  Description of Artificial Sequence: Synthetic oligonucleotide
caacucuguaacccuauuctt

SEQ ID NO: 870 - DNA, 21 bp, Artificial Sequence
  Description of Combined DNA/RNA Molecule: Synthetic oligonucleotide
  Description of Artificial Sequence: Synthetic oligonucleotide
caaacuggaucguaagaagtt

SEQ ID NO: 871 - DNA, 21 bp, Artificial Sequence
  Description of Combined DNA/RNA Molecule: Synthetic oligonucleotide
  Description of Artificial Sequence: Synthetic oligonucleotide
cuucuuacgauccaguuugtt

SEQ ID NO: 872 - DNA, 21 bp, Artificial Sequence
  Description of Combined DNA/RNA Molecule: Synthetic oligonucleotide
  Description of Artificial Sequence: Synthetic oligonucleotide
cuuauuugguaaucugcugtt

SEQ ID NO: 873 - DNA, 21 bp, Artificial Sequence
  Description of Combined DNA/RNA Molecule: Synthetic oligonucleotide
  Description of Artificial Sequence: Synthetic oligonucleotide
cagcagauuaccaaauaagtt

SEQ ID NO: 874 - DNA, 21 bp, Artificial Sequence
  Description of Combined DNA/RNA Molecule: Synthetic oligonucleotide
  Description of Artificial Sequence: Synthetic oligonucleotide
agcaauguggaaaccuaactt

SEQ ID NO: 875 - DNA, 21 bp, Artificial Sequence
  Description of Combined DNA/RNA Molecule: Synthetic oligonucleotide
  Description of Artificial Sequence: Synthetic oligonucleotide
guuagguuuccacauugcutt

SEQ ID NO: 876 - DNA, 21 bp, Artificial Sequence
  Description of Combined DNA/RNA Molecule: Synthetic oligonucleotide
  Description of Artificial Sequence: Synthetic oligonucleotide
acaauaaagcagacccauutt

SEQ ID NO: 877 - DNA, 21 bp, Artificial Sequence
  Description of Combined DNA/RNA Molecule: Synthetic oligonucleotide
  Description of Artificial Sequence: Synthetic oligonucleotide
aaugggucugcuuuauugutt

SEQ ID NO: 878 - DNA, 21 bp, Artificial Sequence
  Description of Combined DNA/RNA Molecule: Synthetic oligonucleotide
  Description of Artificial Sequence: Synthetic oligonucleotide
aaccacuuaguaguguccatt

SEQ ID NO: 879 - DNA, 21 bp, Artificial Sequence
  Description of Combined DNA/RNA Molecule: Synthetic oligonucleotide
  Description of Artificial Sequence: Synthetic oligonucleotide
uggacacuacuaagugguutt

SEQ ID NO: 880 - DNA, 21 bp, Artificial Sequence
  Description of Combined DNA/RNA Molecule: Synthetic oligonucleotide
  Description of Artificial Sequence: Synthetic oligonucleotide
agucaagagccaucuguagtt

SEQ ID NO: 881 - DNA, 21 bp, Artificial Sequence
  Description of Combined DNA/RNA Molecule: Synthetic oligonucleotide
  Description of Artificial Sequence: Synthetic oligonucleotide
cuacagauggcucuugacutt

SEQ ID NO: 882 - DNA, 21 bp, Artificial Sequence
  Description of Combined DNA/RNA Molecule: Synthetic oligonucleotide
  Description of Artificial Sequence: Synthetic oligonucleotide
cucccuagacuucccuauutt

SEQ ID NO: 883 - DNA, 21 bp, Artificial Sequence
  Description of Combined DNA/RNA Molecule: Synthetic oligonucleotide
  Description of Artificial Sequence: Synthetic oligonucleotide
aauagggaagucuagggagtt

SEQ ID NO: 884 - DNA, 21 bp, Artificial Sequence
  Description of Combined DNA/RNA Molecule: Synthetic oligonucleotide
  Description of Artificial Sequence: Synthetic oligonucleotide
auagcuaaauuaaaccaaatt

SEQ ID NO: 885 - DNA, 21 bp, Artificial Sequence
  Description of Combined DNA/RNA Molecule: Synthetic oligonucleotide
  Description of Artificial Sequence: Synthetic oligonucleotide
uuugguuuaauuuagcuautt

SEQ ID NO: 886 - DNA, 21 bp, Artificial Sequence
  Description of Combined DNA/RNA Molecule: Synthetic oligonucleotide
  Description of Artificial Sequence: Synthetic oligonucleotide
uggcugguauaauuccacgtt

SEQ ID NO: 887 - DNA, 21 bp, Artificial Sequence
  Description of Combined DNA/RNA Molecule: Synthetic oligonucleotide
  Description of Artificial Sequence: Synthetic oligonucleotide
cguggaauuauaccagccatt

SEQ ID NO: 888 - DNA, 21 bp, Artificial Sequence
  Description of Combined DNA/RNA Molecule: Synthetic oligonucleotide
  Description of Artificial Sequence: Synthetic oligonucleotide
uuauuugguaaucugcugutt

SEQ ID NO: 889 - DNA, 21 bp, Artificial Sequence
  Description of Combined DNA/RNA Molecule: Synthetic oligonucleotide
  Description of Artificial Sequence: Synthetic oligonucleotide
acagcagauuaccaaauaatt

SEQ ID NO: 890 - DNA, 21 bp, Artificial Sequence
  Description of Combined DNA/RNA Molecule: Synthetic oligonucleotide
  Description of Artificial Sequence: Synthetic oligonucleotide
aacuagauggcuuucucagtt

SEQ ID NO: 891 - DNA, 21 bp, Artificial Sequence
  Description of Combined DNA/RNA Molecule: Synthetic oligonucleotide
  Description of Artificial Sequence: Synthetic oligonucleotide
cugagaaagccaucuaguutt

SEQ ID NO: 892 - DNA, 21 bp, Artificial Sequence
  Description of Combined DNA/RNA Molecule: Synthetic oligonucleotide
  Description of Artificial Sequence: Synthetic oligonucleotide
ucauggcgucgcagccaaatt

SEQ ID NO: 893 - DNA, 21 bp, Artificial Sequence
  Description of Combined DNA/RNA Molecule: Synthetic oligonucleotide
  Description of Artificial Sequence: Synthetic oligonucleotide
uuuggcugcgacgccaugatt

SEQ ID NO: 894 - DNA, 21 bp, Artificial Sequence
  Description of Combined DNA/RNA Molecule: Synthetic oligonucleotide
  Description of Artificial Sequence: Synthetic oligonucleotide
acuggaggauuggcugacatt

SEQ ID NO: 895 - DNA, 21 bp, Artificial Sequence
  Description of Combined DNA/RNA Molecule: Synthetic oligonucleotide
  Description of Artificial Sequence: Synthetic oligonucleotide
ugucagccaauccuccagutt

SEQ ID NO: 896 - DNA, 21 bp, Artificial Sequence
  Description of Combined DNA/RNA Molecule: Synthetic oligonucleotide
  Description of Artificial Sequence: Synthetic oligonucleotide
cuauaauugcacuaucuuutt

SEQ ID NO: 897 - DNA, 21 bp, Artificial Sequence
  Description of Combined DNA/RNA Molecule: Synthetic oligonucleotide
  Description of Artificial Sequence: Synthetic oligonucleotide
aaagauagugcaauuauagtt

SEQ ID NO: 898 - DNA, 21 bp, Artificial Sequence
  Description of Combined DNA/RNA Molecule: Synthetic oligonucleotide
  Description of Artificial Sequence: Synthetic oligonucleotide
aaaggucaccuaaugaagatt

SEQ ID NO: 899 - DNA, 21 bp, Artificial Sequence
  Description of Combined DNA/RNA Molecule: Synthetic oligonucleotide
  Description of Artificial Sequence: Synthetic oligonucleotide
ucuucauuaggugaccuuutt

SEQ ID NO: 900 - DNA, 21 bp, Artificial Sequence
  Description of Combined DNA/RNA Molecule: Synthetic oligonucleotide
  Description of Artificial Sequence: Synthetic oligonucleotide
augaaugcauacucuaguctt

SEQ ID NO: 901 - DNA, 21 bp, Artificial Sequence
  Description of Combined DNA/RNA Molecule: Synthetic oligonucleotide
  Description of Artificial Sequence: Synthetic oligonucleotide
gacuagaguaugcauucautt

SEQ ID NO: 902 - DNA, 21 bp, Artificial Sequence
  Description of Combined DNA/RNA Molecule: Synthetic oligonucleotide
  Description of Artificial Sequence: Synthetic oligonucleotide
aacauauugaauaagccugtt

SEQ ID NO: 903 - DNA, 21 bp, Artificial Sequence
  Description of Combined DNA/RNA Molecule: Synthetic oligonucleotide
  Description of Artificial Sequence: Synthetic oligonucleotide
caggcuuauucaauauguutt

SEQ ID NO: 904 - DNA, 21 bp, Artificial Sequence
  Description of Combined DNA/RNA Molecule: Synthetic oligonucleotide
  Description of Artificial Sequence: Synthetic oligonucleotide
aagaaggcaguugaccaactt

SEQ ID NO: 905 - DNA, 21 bp, Artificial Sequence
  Description of Combined DNA/RNA Molecule: Synthetic oligonucleotide
  Description of Artificial Sequence: Synthetic oligonucleotide
guuggucaacugccuucuutt

SEQ ID NO: 906 - DNA, 21 bp, Artificial Sequence
  Description of Combined DNA/RNA Molecule: Synthetic oligonucleotide
  Description of Artificial Sequence: Synthetic oligonucleotide
gauacuaaaagaacaaucatt

SEQ ID NO: 907 - DNA, 21 bp, Artificial Sequence
  Description of Combined DNA/RNA Molecule: Synthetic oligonucleotide
  Description of Artificial Sequence: Synthetic oligonucleotide
ugauuguucuuuuaguauctt

SEQ ID NO: 908 - DNA, 21 bp, Artificial Sequence
  Description of Combined DNA/RNA Molecule: Synthetic oligonucleotide
  Description of Artificial Sequence: Synthetic oligonucleotide
auacugaaaaucaauaguctt

SEQ ID NO: 909 - DNA, 21 bp, Artificial Sequence
  Description of Combined DNA/RNA Molecule: Synthetic oligonucleotide
  Description of Artificial Sequence: Synthetic oligonucleotide
gacuauugauuuucaguautt

SEQ ID NO: 910 - DNA, 21 bp, Artificial Sequence
  Description of Combined DNA/RNA Molecule: Synthetic oligonucleotide
  Description of Artificial Sequence: Synthetic oligonucleotide
aaaaaggaacuagauggcutt

SEQ ID NO: 911 - DNA, 21 bp, Artificial Sequence
  Description of Combined DNA/RNA Molecule: Synthetic oligonucleotide
  Description of Artificial Sequence: Synthetic oligonucleotide
agccaucuaguuccuuuuutt

SEQ ID NO: 912 - DNA, 21 bp, Artificial Sequence
  Description of Combined DNA/RNA Molecule: Synthetic oligonucleotide
  Description of Artificial Sequence: Synthetic oligonucleotide
gaacuagauggcuuucucatt

SEQ ID NO: 913 - DNA, 21 bp, Artificial Sequence
  Description of Combined DNA/RNA Molecule: Synthetic oligonucleotide
  Description of Artificial Sequence: Synthetic oligonucleotide
ugagaaagccaucuaguuctt

SEQ ID NO: 914 - DNA, 21 bp, Artificial Sequence
  Description of Combined DNA/RNA Molecule: Synthetic oligonucleotide
  Description of Artificial Sequence: Synthetic oligonucleotide
gaaaccuaacugaagaccutt

SEQ ID NO: 915 - DNA, 21 bp, Artificial Sequence
  Description of Combined DNA/RNA Molecule: Synthetic oligonucleotide
  Description of Artificial Sequence: Synthetic oligonucleotide
aggucuucaguuagguuuctt

SEQ ID NO: 916 - DNA, 21 bp, Artificial Sequence
  Description of Combined DNA/RNA Molecule: Synthetic oligonucleotide
  Description of Artificial Sequence: Synthetic oligonucleotide
uacccaucaacacugguaatt

SEQ ID NO: 917 - DNA, 21 bp, Artificial Sequence
  Description of Combined DNA/RNA Molecule: Synthetic oligonucleotide
  Description of Artificial Sequence: Synthetic oligonucleotide
uuaccaguguugauggguatt

SEQ ID NO: 918 - DNA, 21 bp, Artificial Sequence
  Description of Combined DNA/RNA Molecule: Synthetic oligonucleotide
  Description of Artificial Sequence: Synthetic oligonucleotide
auuuugauaucuacccauutt

SEQ ID NO: 919 - DNA, 21 bp, Artificial Sequence
  Description of Combined DNA/RNA Molecule: Synthetic oligonucleotide
  Description of Artificial Sequence: Synthetic oligonucleotide
aauggguagauaucaaaautt

SEQ ID NO: 920 - DNA, 21 bp, Artificial Sequence
  Description of Combined DNA/RNA Molecule: Synthetic oligonucleotide
  Description of Artificial Sequence: Synthetic oligonucleotide
aucccuauaguucacuuugtt

SEQ ID NO: 921 - DNA, 21 bp, Artificial Sequence
  Description of Combined DNA/RNA Molecule: Synthetic oligonucleotide
  Description of Artificial Sequence: Synthetic oligonucleotide
caaagugaacuauagggautt

SEQ ID NO: 922 - DNA, 21 bp, Artificial Sequence
  Description of Combined DNA/RNA Molecule: Synthetic oligonucleotide
  Description of Artificial Sequence: Synthetic oligonucleotide
augggcuauaauugcacuatt

SEQ ID NO: 923 - DNA, 21 bp, Artificial Sequence
  Description of Combined DNA/RNA Molecule: Synthetic oligonucleotide
  Description of Artificial Sequence: Synthetic oligonucleotide
uagugcaauuauagcccautt

SEQ ID NO: 924 - DNA, 21 bp, Artificial Sequence
  Description of Combined DNA/RNA Molecule: Synthetic oligonucleotide
  Description of Artificial Sequence: Synthetic oligonucleotide
agauuaccucugcgagccctt

SEQ ID NO: 925 - DNA, 21 bp, Artificial Sequence
  Description of Combined DNA/RNA Molecule: Synthetic oligonucleotide
  Description of Artificial Sequence: Synthetic oligonucleotide
gggcucgcagagguaaucutt

SEQ ID NO: 926 - DNA, 21 bp, Artificial Sequence
  Description of Combined DNA/RNA Molecule: Synthetic oligonucleotide
  Description of Artificial Sequence: Synthetic oligonucleotide
uaauuccacguacccuucatt

SEQ ID NO: 927 - DNA, 21 bp, Artificial Sequence
  Description of Combined DNA/RNA Molecule: Synthetic oligonucleotide
  Description of Artificial Sequence: Synthetic oligonucleotide
ugaaggguacguggaauuatt

SEQ ID NO: 928 - DNA, 21 bp, Artificial Sequence
  Description of Combined DNA/RNA Molecule: Synthetic oligonucleotide
  Description of Artificial Sequence: Synthetic oligonucleotide
gucguucccacucaguuuutt

SEQ ID NO: 929 - DNA, 21 bp, Artificial Sequence
  Description of Combined DNA/RNA Molecule: Synthetic oligonucleotide
  Description of Artificial Sequence: Synthetic oligonucleotide
aaaacugagugggaacgactt

SEQ ID NO: 930 - DNA, 21 bp, Artificial Sequence
  Description of Combined DNA/RNA Molecule: Synthetic oligonucleotide
  Description of Artificial Sequence: Synthetic oligonucleotide
aaaucaaucccuguugacutt

SEQ ID NO: 931 - DNA, 21 bp, Artificial Sequence
  Description of Combined DNA/RNA Molecule: Synthetic oligonucleotide
  Description of Artificial Sequence: Synthetic oligonucleotide
agucaacagggauugauuutt

SEQ ID NO: 932 - DNA, 21 bp, Artificial Sequence
  Description of Combined DNA/RNA Molecule: Synthetic oligonucleotide
  Description of Artificial Sequence: Synthetic oligonucleotide
ucauagagcaaagaacauatt

SEQ ID NO: 933 - DNA, 21 bp, Artificial Sequence
  Description of Combined DNA/RNA Molecule: Synthetic oligonucleotide
  Description of Artificial Sequence: Synthetic oligonucleotide
uauguucuuugcucuaugatt

SEQ ID NO: 934 - DNA, 21 bp, Artificial Sequence
  Description of Combined DNA/RNA Molecule: Synthetic oligonucleotide
  Description of Artificial Sequence: Synthetic oligonucleotide
uuacuacaguagcacuuggtt

SEQ ID NO: 935 - DNA, 21 bp, Artificial Sequence
  Description of Combined DNA/RNA Molecule: Synthetic oligonucleotide
  Description of Artificial Sequence: Synthetic oligonucleotide
ccaagugcuacuguaguaatt

SEQ ID NO: 936 - DNA, 21 bp, Artificial Sequence
  Description of Combined DNA/RNA Molecule: Synthetic oligonucleotide
  Description of Artificial Sequence: Synthetic oligonucleotide
auguggaaaccuaacugaatt

SEQ ID NO: 937 - DNA, 21 bp, Artificial Sequence
  Description of Combined DNA/RNA Molecule: Synthetic oligonucleotide
  Description of Artificial Sequence: Synthetic oligonucleotide
uucaguuagguuuccacautt

SEQ ID NO: 938 - DNA, 21 bp, Artificial Sequence
  Description of Combined DNA/RNA Molecule: Synthetic oligonucleotide
  Description of Artificial Sequence: Synthetic oligonucleotide
uguggaaaccuaacugaagtt

SEQ ID NO: 939 - DNA, 21 bp, Artificial Sequence
  Description of Combined DNA/RNA Molecule: Synthetic oligonucleotide
  Description of Artificial Sequence: Synthetic oligonucleotide
cuucaguuagguuuccacatt

SEQ ID NO: 940 - DNA, 21 bp, Artificial Sequence
  Description of Combined DNA/RNA Molecule: Synthetic oligonucleotide
  Description of Artificial Sequence: Synthetic oligonucleotide
ucuuccuuaaaugaaagggtt

SEQ ID NO: 941 - DNA, 21 bp, Artificial Sequence
  Description of Combined DNA/RNA Molecule: Synthetic oligonucleotide
  Description of Artificial Sequence: Synthetic oligonucleotide
cccuuucauuuaaggaagatt

SEQ ID NO: 942 - DNA, 21 bp, Artificial Sequence
  Description of Combined DNA/RNA Molecule: Synthetic oligonucleotide
  Description of Artificial Sequence: Synthetic oligonucleotide
ugaagaaccucuaagucaatt

SEQ ID NO: 943 - DNA, 21 bp, Artificial Sequence
  Description of Combined DNA/RNA Molecule: Synthetic oligonucleotide
  Description of Artificial Sequence: Synthetic oligonucleotide
uugacuuagagguucuucatt

SEQ ID NO: 944 - DNA, 21 bp, Artificial Sequence
  Description of Combined DNA/RNA Molecule: Synthetic oligonucleotide
  Description of Artificial Sequence: Synthetic oligonucleotide
agaggucuaaaguggaagatt

SEQ ID NO: 945 - DNA, 21 bp, Artificial Sequence
  Description of Combined DNA/RNA Molecule: Synthetic oligonucleotide
  Description of Artificial Sequence: Synthetic oligonucleotide
ucuuccacuuuagaccucutt

SEQ ID NO: 946 - DNA, 21 bp, Artificial Sequence
  Description of Combined DNA/RNA Molecule: Synthetic oligonucleotide
  Description of Artificial Sequence: Synthetic oligonucleotide
auaucuacccauuuuucugtt

SEQ ID NO: 947 - DNA, 21 bp, Artificial Sequence
  Description of Combined DNA/RNA Molecule: Synthetic oligonucleotide
  Description of Artificial Sequence: Synthetic oligonucleotide
cagaaaaauggguagauautt

SEQ ID NO: 948 - DNA, 21 bp, Artificial Sequence
  Description of Combined DNA/RNA Molecule: Synthetic oligonucleotide
  Description of Artificial Sequence: Synthetic oligonucleotide
uaagccugaagugaaucagtt

SEQ ID NO: 949 - DNA, 21 bp, Artificial Sequence
  Description of Combined DNA/RNA Molecule: Synthetic oligonucleotide
  Description of Artificial Sequence: Synthetic oligonucleotide
cugauucacuucaggcuuatt

SEQ ID NO: 950 - DNA, 21 bp, Artificial Sequence
  Description of Combined DNA/RNA Molecule: Synthetic oligonucleotide
  Description of Artificial Sequence: Synthetic oligonucleotide
agaugcagaccauuuaauutt

SEQ ID NO: 951 - DNA, 21 bp, Artificial Sequence
  Description of Combined DNA/RNA Molecule: Synthetic oligonucleotide
  Description of Artificial Sequence: Synthetic oligonucleotide
aauuaaauggucugcaucutt

SEQ ID NO: 952 - DNA, 21 bp, Artificial Sequence
  Description of Combined DNA/RNA Molecule: Synthetic oligonucleotide
  Description of Artificial Sequence: Synthetic oligonucleotide
aguguuguuuguccaauuctt

SEQ ID NO: 953 - DNA, 21 bp, Artificial Sequence
  Description of Combined DNA/RNA Molecule: Synthetic oligonucleotide
  Description of Artificial Sequence: Synthetic oligonucleotide
gaauuggacaaacaacacutt

SEQ ID NO: 954 - DNA, 21 bp, Artificial Sequence
  Description of Combined DNA/RNA Molecule: Synthetic oligonucleotide
  Description of Artificial Sequence: Synthetic oligonucleotide
cuauaaugaagagcuuuuutt

SEQ ID NO: 955 - DNA, 21 bp, Artificial Sequence
  Description of Combined DNA/RNA Molecule: Synthetic oligonucleotide
  Description of Artificial Sequence: Synthetic oligonucleotide
aaaaagcucuucauuauagtt

SEQ ID NO: 956 - DNA, 21 bp, Artificial Sequence
  Description of Combined DNA/RNA Molecule: Synthetic oligonucleotide
  Description of Artificial Sequence: Synthetic oligonucleotide
agaggagugauaauuaaagtt

SEQ ID NO: 957 - DNA, 21 bp, Artificial Sequence
  Description of Combined DNA/RNA Molecule: Synthetic oligonucleotide
  Description of Artificial Sequence: Synthetic oligonucleotide
cuuuaauuaucacuccucutt

SEQ ID NO: 958 - DNA, 21 bp, Artificial Sequence
  Description of Combined DNA/RNA Molecule: Synthetic oligonucleotide
  Description of Artificial Sequence: Synthetic oligonucleotide
uuucucuguuacaauacautt

SEQ ID NO: 959 - DNA, 21 bp, Artificial Sequence
  Description of Combined DNA/RNA Molecule: Synthetic oligonucleotide
  Description of Artificial Sequence: Synthetic oligonucleotide
auguauuguaacagagaaatt

SEQ ID NO: 960 - DNA, 21 bp, Artificial Sequence
  Description of Combined DNA/RNA Molecule: Synthetic oligonucleotide
  Description of Artificial Sequence: Synthetic oligonucleotide
aacaucuauaauugcaacatt

SEQ ID NO: 961 - DNA, 21 bp, Artificial Sequence
  Description of Combined DNA/RNA Molecule: Synthetic oligonucleotide
  Description of Artificial Sequence: Synthetic oligonucleotide
uguugcaauuauagauguutt

SEQ ID NO: 962 - DNA, 21 bp, Artificial Sequence
  Description of Combined DNA/RNA Molecule: Synthetic oligonucleotide
  Description of Artificial Sequence: Synthetic oligonucleotide
ugcuagaaguacauaagactt

SEQ ID NO: 963 - DNA, 21 bp, Artificial Sequence
  Description of Combined DNA/RNA Molecule: Synthetic oligonucleotide
  Description of Artificial Sequence: Synthetic oligonucleotide
gucuuauguacuucuagcatt

SEQ ID NO: 964 - DNA, 21 bp, Artificial Sequence
  Description of Combined DNA/RNA Molecule: Synthetic oligonucleotide
  Description of Artificial Sequence: Synthetic oligonucleotide
aauguacucaagacugauctt

SEQ ID NO: 965 - DNA, 21 bp, Artificial Sequence
  Description of Combined DNA/RNA Molecule: Synthetic oligonucleotide
  Description of Artificial Sequence: Synthetic oligonucleotide
gaucagucuugaguacauutt

SEQ ID NO: 966 - DNA, 21 bp, Artificial Sequence
  Description of Combined DNA/RNA Molecule: Synthetic oligonucleotide
  Description of Artificial Sequence: Synthetic oligonucleotide
guacucaagacugaucuuctt

SEQ ID NO: 967 - DNA, 21 bp, Artificial Sequence
  Description of Combined DNA/RNA Molecule: Synthetic oligonucleotide
  Description of Artificial Sequence: Synthetic oligonucleotide
gaagaucagucuugaguactt

SEQ ID NO: 968 - DNA, 21 bp, Artificial Sequence
  Description of Combined DNA/RNA Molecule: Synthetic oligonucleotide
  Description of Artificial Sequence: Synthetic oligonucleotide
cacucugauaaacucaaugtt

SEQ ID NO: 969 - DNA, 21 bp, Artificial Sequence
  Description of Combined DNA/RNA Molecule: Synthetic oligonucleotide
  Description of Artificial Sequence: Synthetic oligonucleotide
cauugaguuuaucagagugtt

SEQ ID NO: 970 - DNA, 21 bp, Artificial Sequence
  Description of Combined DNA/RNA Molecule: Synthetic oligonucleotide
  Description of Artificial Sequence: Synthetic oligonucleotide
aagagcagauuaccucugctt

SEQ ID NO: 971 - DNA, 21 bp, Artificial Sequence
  Description of Combined DNA/RNA Molecule: Synthetic oligonucleotide
  Description of Artificial Sequence: Synthetic oligonucleotide
gcagagguaaucugcucuutt

SEQ ID NO: 972 - DNA, 21 bp, Artificial Sequence
  Description of Combined DNA/RNA Molecule: Synthetic oligonucleotide
  Description of Artificial Sequence: Synthetic oligonucleotide
ucugcgagcccagaucaactt

SEQ ID NO: 973 - DNA, 21 bp, Artificial Sequence
  Description of Combined DNA/RNA Molecule: Synthetic oligonucleotide
  Description of Artificial Sequence: Synthetic oligonucleotide
guugaucugggcucgcagatt

SEQ ID NO: 974 - DNA, 21 bp, Artificial Sequence
  Description of Combined DNA/RNA Molecule: Synthetic oligonucleotide
  Description of Artificial Sequence: Synthetic oligonucleotide
aacuugagccuuguguauatt

SEQ ID NO: 975 - DNA, 21 bp, Artificial Sequence
  Description of Combined DNA/RNA Molecule: Synthetic oligonucleotide
  Description of Artificial Sequence: Synthetic oligonucleotide
uauacacaaggcucaaguutt

SEQ ID NO: 976 - DNA, 21 bp, Artificial Sequence
  Description of Combined DNA/RNA Molecule: Synthetic oligonucleotide
  Description of Artificial Sequence: Synthetic oligonucleotide
gaauauauauaucagccggtt

SEQ ID NO: 977 - DNA, 21 bp, Artificial Sequence
  Description of Combined DNA/RNA Molecule: Synthetic oligonucleotide
  Description of Artificial Sequence: Synthetic oligonucleotide
ccggcugauauauauauuctt

SEQ ID NO: 978 - DNA, 21 bp, Artificial Sequence
  Description of Combined DNA/RNA Molecule: Synthetic oligonucleotide
  Description of Artificial Sequence: Synthetic oligonucleotide
ugucaucccuauaguucactt

SEQ ID NO: 979 - DNA, 21 bp, Artificial Sequence
  Description of Combined DNA/RNA Molecule: Synthetic oligonucleotide
  Description of Artificial Sequence: Synthetic oligonucleotide
gugaacuauagggaugacatt

SEQ ID NO: 980 - DNA, 21 bp, Artificial Sequence
  Description of Combined DNA/RNA Molecule: Synthetic oligonucleotide
  Description of Artificial Sequence: Synthetic oligonucleotide
gaucuggcaaccauauuuctt

SEQ ID NO: 981 - DNA, 21 bp, Artificial Sequence
  Description of Combined DNA/RNA Molecule: Synthetic oligonucleotide
  Description of Artificial Sequence: Synthetic oligonucleotide
gaaauaugguugccagauctt

SEQ ID NO: 982 - DNA, 21 bp, Artificial Sequence
  Description of Combined DNA/RNA Molecule: Synthetic oligonucleotide
  Description of Artificial Sequence: Synthetic oligonucleotide
uggcaaccauauuucuggatt

SEQ ID NO: 983 - DNA, 21 bp, Artificial Sequence
  Description of Combined DNA/RNA Molecule: Synthetic oligonucleotide
  Description of Artificial Sequence: Synthetic oligonucleotide
uccagaaauaugguugccatt

SEQ ID NO: 984 - DNA, 21 bp, Artificial Sequence
  Description of Combined DNA/RNA Molecule: Synthetic oligonucleotide
  Description of Artificial Sequence: Synthetic oligonucleotide
gauguuuaccgaaguguugtt

SEQ ID NO: 985 - DNA, 21 bp, Artificial Sequence
  Description of Combined DNA/RNA Molecule: Synthetic oligonucleotide
  Description of Artificial Sequence: Synthetic oligonucleotide
caacacuucgguaaacauctt

SEQ ID NO: 986 - DNA, 21 bp, Artificial Sequence
  Description of Combined DNA/RNA Molecule: Synthetic oligonucleotide
  Description of Artificial Sequence: Synthetic oligonucleotide
uuccuuaucgagaaucuaatt

SEQ ID NO: 987 - DNA, 21 bp, Artificial Sequence
  Description of Combined DNA/RNA Molecule: Synthetic oligonucleotide
  Description of Artificial Sequence: Synthetic oligonucleotide
uuagauucucgauaaggaatt

SEQ ID NO: 988 - DNA, 21 bp, Artificial Sequence
  Description of Combined DNA/RNA Molecule: Synthetic oligonucleotide
  Description of Artificial Sequence: Synthetic oligonucleotide
agcuuaauugcuuucuggatt

SEQ ID NO: 989 - DNA, 21 bp, Artificial Sequence
  Description of Combined DNA/RNA Molecule: Synthetic oligonucleotide
  Description of Artificial Sequence: Synthetic oligonucleotide
uccagaaagcaauuaagcutt

SEQ ID NO: 990 - DNA, 21 bp, Artificial Sequence
  Description of Combined DNA/RNA Molecule: Synthetic oligonucleotide
  Description of Artificial Sequence: Synthetic oligonucleotide
uugcuauuaugggagaccatt

SEQ ID NO: 991 - DNA, 21 bp, Artificial Sequence
  Description of Combined DNA/RNA Molecule: Synthetic oligonucleotide
  Description of Artificial Sequence: Synthetic oligonucleotide
uggucucccauaauagcaatt

SEQ ID NO: 992 - DNA, 21 bp, Artificial Sequence
  Description of Combined DNA/RNA Molecule: Synthetic oligonucleotide
  Description of Artificial Sequence: Synthetic oligonucleotide
gucauggcgucgcagccaatt

SEQ ID NO: 993 - DNA, 21 bp, Artificial Sequence
  Description of Combined DNA/RNA Molecule: Synthetic oligonucleotide
  Description of Artificial Sequence: Synthetic oligonucleotide
uuggcugcgacgccaugactt

SEQ ID NO: 994 - DNA, 21 bp, Artificial Sequence
  Description of Combined DNA/RNA Molecule: Synthetic oligonucleotide
  Description of Artificial Sequence: Synthetic oligonucleotide
uaauugcacuaucuuugcgtt

SEQ ID NO: 995 - DNA, 21 bp, Artificial Sequence
  Description of Combined DNA/RNA Molecule: Synthetic oligonucleotide
  Description of Artificial Sequence: Synthetic oligonucleotide
cgcaaagauagugcaauuatt

SEQ ID NO: 996 - DNA, 21 bp, Artificial Sequence
  Description of Combined DNA/RNA Molecule: Synthetic oligonucleotide
  Description of Artificial Sequence: Synthetic oligonucleotide
cuaucuuugcguauggccatt

SEQ ID NO: 997 - DNA, 21 bp, Artificial Sequence
  Description of Combined DNA/RNA Molecule: Synthetic oligonucleotide
  Description of Artificial Sequence: Synthetic oligonucleotide
uggccauacgcaaagauagtt

SEQ ID NO: 998 - DNA, 21 bp, Artificial Sequence
  Description of Combined DNA/RNA Molecule: Synthetic oligonucleotide
  Description of Artificial Sequence: Synthetic oligonucleotide
ucccuauaguucacuuugutt

SEQ ID NO: 999 - DNA, 21 bp, Artificial Sequence
  Description of Combined DNA/RNA Molecule: Synthetic oligonucleotide
  Description of Artificial Sequence: Synthetic oligonucleotide
acaaagugaacuauagggatt

SEQ ID NO: 1000 - DNA, 21 bp, Artificial Sequence
  Description of Combined DNA/RNA Molecule: Synthetic oligonucleotide
  Description of Artificial Sequence: Synthetic oligonucleotide
ucaaccuuuaauucacuugtt

SEQ ID NO: 1001 - DNA, 21 bp, Artificial Sequence
  Description of Combined DNA/RNA Molecule: Synthetic oligonucleotide
  Description of Artificial Sequence: Synthetic oligonucleotide
caagugaauuaaagguugatt

SEQ ID NO: 1002 - DNA, 21 bp, Artificial Sequence
  Description of Combined DNA/RNA Molecule: Synthetic oligonucleotide
  Description of Artificial Sequence: Synthetic oligonucleotide
ggcaaccauauuucuggaatt

SEQ ID NO: 1003 - DNA, 21 bp, Artificial Sequence
  Description of Combined DNA/RNA Molecule: Synthetic oligonucleotide
  Description of Artificial Sequence: Synthetic oligonucleotide
uuccagaaauaugguugcctt

SEQ ID NO: 1004 - DNA, 21 bp, Artificial Sequence
  Description of Combined DNA/RNA Molecule: Synthetic oligonucleotide
  Description of Artificial Sequence: Synthetic oligonucleotide
auguacucaagacugaucutt

SEQ ID NO: 1005 - DNA, 21 bp, Artificial Sequence
  Description of Combined DNA/RNA Molecule: Synthetic oligonucleotide
  Description of Artificial Sequence: Synthetic oligonucleotide
agaucagucuugaguacautt

SEQ ID NO: 1006 - DNA, 21 bp, Artificial Sequence
  Description of Combined DNA/RNA Molecule: Synthetic oligonucleotide
  Description of Artificial Sequence: Synthetic oligonucleotide
gcagaccauuuaauuuggctt

SEQ ID NO: 1007 - DNA, 21 bp, Artificial Sequence
  Description of Combined DNA/RNA Molecule: Synthetic oligonucleotide
  Description of Artificial Sequence: Synthetic oligonucleotide
gccaaauuaaauggucugctt

SEQ ID NO: 1008 - DNA, 21 bp, Artificial Sequence
  Description of Combined DNA/RNA Molecule: Synthetic oligonucleotide
  Description of Artificial Sequence: Synthetic oligonucleotide
ucugagagacuacagaugutt

SEQ ID NO: 1009 - DNA, 21 bp, Artificial Sequence
  Description of Combined DNA/RNA Molecule: Synthetic oligonucleotide
  Description of Artificial Sequence: Synthetic oligonucleotide
acaucuguagucucucagatt

SEQ ID NO: 1010 - DNA, 21 bp, Artificial Sequence
  Description of Combined DNA/RNA Molecule: Synthetic oligonucleotide
  Description of Artificial Sequence: Synthetic oligonucleotide
ugcucauagagcaaagaactt

SEQ ID NO: 1011 - DNA, 21 bp, Artificial Sequence
  Description of Combined DNA/RNA Molecule: Synthetic oligonucleotide
  Description of Artificial Sequence: Synthetic oligonucleotide
guucuuugcucuaugagcatt

SEQ ID NO: 1012 - DNA, 21 bp, Artificial Sequence
  Description of Combined DNA/RNA Molecule: Synthetic oligonucleotide
  Description of Artificial Sequence: Synthetic oligonucleotide
acauaagaccuuauuuggutt

SEQ ID NO: 1013 - DNA, 21 bp, Artificial Sequence
  Description of Combined DNA/RNA Molecule: Synthetic oligonucleotide
  Description of Artificial Sequence: Synthetic oligonucleotide
accaaauaaggucuuaugutt

SEQ ID NO: 1014 - DNA, 21 bp, Artificial Sequence
  Description of Combined DNA/RNA Molecule: Synthetic oligonucleotide
  Description of Artificial Sequence: Synthetic oligonucleotide
uuugugcugauucugauggtt

SEQ ID NO: 1015 - DNA, 21 bp, Artificial Sequence
  Description of Combined DNA/RNA Molecule: Synthetic oligonucleotide
  Description of Artificial Sequence: Synthetic oligonucleotide
ccaucagaaucagcacaaatt

SEQ ID NO: 1016 - DNA, 21 bp, Artificial Sequence
  Description of Combined DNA/RNA Molecule: Synthetic oligonucleotide
  Description of Artificial Sequence: Synthetic oligonucleotide
ccaucaacacugguaagaatt

SEQ ID NO: 1017 - DNA, 21 bp, Artificial Sequence
  Description of Combined DNA/RNA Molecule: Synthetic oligonucleotide
  Description of Artificial Sequence: Synthetic oligonucleotide
uucuuaccaguguugauggtt

SEQ ID NO: 1018 - DNA, 21 bp, Artificial Sequence
  Description of Combined DNA/RNA Molecule: Synthetic oligonucleotide
  Description of Artificial Sequence: Synthetic oligonucleotide
agacaauuccggauguggatt

SEQ ID NO: 1019 - DNA, 21 bp, Artificial Sequence
  Description of Combined DNA/RNA Molecule: Synthetic oligonucleotide
  Description of Artificial Sequence: Synthetic oligonucleotide
uccacauccggaauugucutt

SEQ ID NO: 1020 - DNA, 21 bp, Artificial Sequence
  Description of Combined DNA/RNA Molecule: Synthetic oligonucleotide
  Description of Artificial Sequence: Synthetic oligonucleotide
gaacuugagccuuguguautt

SEQ ID NO: 1021 - DNA, 21 bp, Artificial Sequence
  Description of Combined DNA/RNA Molecule: Synthetic oligonucleotide
  Description of Artificial Sequence: Synthetic oligonucleotide
auacacaaggcucaaguuctt

SEQ ID NO: 1022 - DNA, 21 bp, Artificial Sequence
  Description of Combined DNA/RNA Molecule: Synthetic oligonucleotide
  Description of Artificial Sequence: Synthetic oligonucleotide
uaauuuggcagagcggaaatt

SEQ ID NO: 1023 - DNA, 21 bp, Artificial Sequence
  Description of Combined DNA/RNA Molecule: Synthetic oligonucleotide
  Description of Artificial Sequence: Synthetic oligonucleotide
uuuccgcucugccaaauuatt

SEQ ID NO: 1024 - DNA, 21 bp, Artificial Sequence
  Description of Combined DNA/RNA Molecule: Synthetic oligonucleotide
  Description of Artificial Sequence: Synthetic oligonucleotide
uggaugaaguuauuaugggtt

SEQ ID NO: 1025 - DNA, 21 bp, Artificial Sequence
  Description of Combined DNA/RNA Molecule: Synthetic oligonucleotide
  Description of Artificial Sequence: Synthetic oligonucleotide
cccauaauaacuucauccatt

SEQ ID NO: 1026 - DNA, 21 bp, Artificial Sequence
  Description of Combined DNA/RNA Molecule: Synthetic oligonucleotide
  Description of Artificial Sequence: Synthetic oligonucleotide
aucuacaugaacuacaagatt

SEQ ID NO: 1027 - DNA, 21 bp, Artificial Sequence
  Description of Combined DNA/RNA Molecule: Synthetic oligonucleotide
  Description of Artificial Sequence: Synthetic oligonucleotide
ucuuguaguucauguagautt

SEQ ID NO: 1028 - DNA, 21 bp, Artificial Sequence
  Description of Combined DNA/RNA Molecule: Synthetic oligonucleotide
  Description of Artificial Sequence: Synthetic oligonucleotide
gguauuuuugaucuggcaatt

SEQ ID NO: 1029 - DNA, 21 bp, Artificial Sequence
  Description of Combined DNA/RNA Molecule: Synthetic oligonucleotide
  Description of Artificial Sequence: Synthetic oligonucleotide
uugccagaucaaaaauacctt

SEQ ID NO: 1030 - DNA, 21 bp, Artificial Sequence
  Description of Combined DNA/RNA Molecule: Synthetic oligonucleotide
  Description of Artificial Sequence: Synthetic oligonucleotide
cuaaugaagaguauaccugtt

SEQ ID NO: 1031 - DNA, 21 bp, Artificial Sequence
  Description of Combined DNA/RNA Molecule: Synthetic oligonucleotide
  Description of Artificial Sequence: Synthetic oligonucleotide
cagguauacucuucauuagtt

SEQ ID NO: 1032 - DNA, 21 bp, Artificial Sequence
  Description of Combined DNA/RNA Molecule: Synthetic oligonucleotide
  Description of Artificial Sequence: Synthetic oligonucleotide
uuugagaaacuuacugauatt

SEQ ID NO: 1033 - DNA, 21 bp, Artificial Sequence
  Description of Combined DNA/RNA Molecule: Synthetic oligonucleotide
  Description of Artificial Sequence: Synthetic oligonucleotide
uaucaguaaguuucucaaatt

SEQ ID NO: 1034 - DNA, 21 bp, Artificial Sequence
  Description of Combined DNA/RNA Molecule: Synthetic oligonucleotide
  Description of Artificial Sequence: Synthetic oligonucleotide
cgauaagauagaagaucaatt

SEQ ID NO: 1035 - DNA, 21 bp, Artificial Sequence
  Description of Combined DNA/RNA Molecule: Synthetic oligonucleotide
  Description of Artificial Sequence: Synthetic oligonucleotide
uugaucuucuaucuuaucgtt

SEQ ID NO: 1036 - DNA, 21 bp, Artificial Sequence
  Description of Combined DNA/RNA Molecule: Synthetic oligonucleotide
  Description of Artificial Sequence: Synthetic oligonucleotide
cuggcaaccauauuucuggtt

SEQ ID NO: 1037 - DNA, 21 bp, Artificial Sequence
  Description of Combined DNA/RNA Molecule: Synthetic oligonucleotide
  Description of Artificial Sequence: Synthetic oligonucleotide
ccagaaauaugguugccagtt

SEQ ID NO: 1038 - DNA, 21 bp, Artificial Sequence
  Description of Combined DNA/RNA Molecule: Synthetic oligonucleotide
  Description of Artificial Sequence: Synthetic oligonucleotide
uagauaccauuacuacagutt

SEQ ID NO: 1039 - DNA, 21 bp, Artificial Sequence
  Description of Combined DNA/RNA Molecule: Synthetic oligonucleotide
  Description of Artificial Sequence: Synthetic oligonucleotide
acuguaguaaugguaucuatt

SEQ ID NO: 1040 - DNA, 21 bp, Artificial Sequence
  Description of Combined DNA/RNA Molecule: Synthetic oligonucleotide
  Description of Artificial Sequence: Synthetic oligonucleotide
guauuaaauuggguuucautt

SEQ ID NO: 1041 - DNA, 21 bp, Artificial Sequence
  Description of Combined DNA/RNA Molecule: Synthetic oligonucleotide
  Description of Artificial Sequence: Synthetic oligonucleotide
augaaacccaauuuaauactt

SEQ ID NO: 1042 - DNA, 21 bp, Artificial Sequence
  Description of Combined DNA/RNA Molecule: Synthetic oligonucleotide
  Description of Artificial Sequence: Synthetic oligonucleotide
aagaccuuauuugguaauctt

SEQ ID NO: 1043 - DNA, 21 bp, Artificial Sequence
  Description of Combined DNA/RNA Molecule: Synthetic oligonucleotide
  Description of Artificial Sequence: Synthetic oligonucleotide
gauuaccaaauaaggucuutt

SEQ ID NO: 1044 - DNA, 21 bp, Artificial Sequence
  Description of Combined DNA/RNA Molecule: Synthetic oligonucleotide
  Description of Artificial Sequence: Synthetic oligonucleotide
gcuguugauaagagagcuctt

SEQ ID NO: 1045 - DNA, 21 bp, Artificial Sequence
  Description of Combined DNA/RNA Molecule: Synthetic oligonucleotide
  Description of Artificial Sequence: Synthetic oligonucleotide
gagcucucuuaucaacagctt

SEQ ID NO: 1046 - DNA, 21 bp, Artificial Sequence
  Description of Combined DNA/RNA Molecule: Synthetic oligonucleotide
  Description of Artificial Sequence: Synthetic oligonucleotide
uacucauguuucucagauutt

SEQ ID NO: 1047 - DNA, 21 bp, Artificial Sequence
  Description of Combined DNA/RNA Molecule: Synthetic oligonucleotide
  Description of Artificial Sequence: Synthetic oligonucleotide
aaucugagaaacaugaguatt

SEQ ID NO: 1048 - DNA, 21 bp, Artificial Sequence
  Description of Combined DNA/RNA Molecule: Synthetic oligonucleotide
  Description of Artificial Sequence: Synthetic oligonucleotide
cagauggacguaaggcagctt

SEQ ID NO: 1049 - DNA, 21 bp, Artificial Sequence
  Description of Combined DNA/RNA Molecule: Synthetic oligonucleotide
  Description of Artificial Sequence: Synthetic oligonucleotide
gcugccuuacguccaucugtt

SEQ ID NO: 1050 - DNA, 21 bp, Artificial Sequence
  Description of Combined DNA/RNA Molecule: Synthetic oligonucleotide
  Description of Artificial Sequence: Synthetic oligonucleotide
uaucccaacagguacgacatt

SEQ ID NO: 1051 - DNA, 21 bp, Artificial Sequence
  Description of Combined DNA/RNA Molecule: Synthetic oligonucleotide
  Description of Artificial Sequence: Synthetic oligonucleotide
ugucguaccuguugggauatt

SEQ ID NO: 1052 - DNA, 21 bp, Artificial Sequence
  Description of Combined DNA/RNA Molecule: Synthetic oligonucleotide
  Description of Artificial Sequence: Synthetic oligonucleotide
cauugcuauuaugggagactt

SEQ ID NO: 1053 - DNA, 21 bp, Artificial Sequence
  Description of Combined DNA/RNA Molecule: Synthetic oligonucleotide
  Description of Artificial Sequence: Synthetic oligonucleotide
gucucccauaauagcaaugtt

SEQ ID NO: 1054 - DNA, 21 bp, Artificial Sequence
  Description of Combined DNA/RNA Molecule: Synthetic oligonucleotide
  Description of Artificial Sequence: Synthetic oligonucleotide
cccucaguaaauccauggutt

SEQ ID NO: 1055 - DNA, 21 bp, Artificial Sequence
  Description of Combined DNA/RNA Molecule: Synthetic oligonucleotide
  Description of Artificial Sequence: Synthetic oligonucleotide
accauggauuuacugagggtt

SEQ ID NO: 1056 - DNA, 21 bp, Artificial Sequence
  Description of Combined DNA/RNA Molecule: Synthetic oligonucleotide
  Description of Artificial Sequence: Synthetic oligonucleotide
ggucauuacugcccuuguatt

SEQ ID NO: 1057 - DNA, 21 bp, Artificial Sequence
  Description of Combined DNA/RNA Molecule: Synthetic oligonucleotide
  Description of Artificial Sequence: Synthetic oligonucleotide
uacaagggcaguaaugacctt

SEQ ID NO: 1058 - DNA, 21 bp, Artificial Sequence
  Description of Combined DNA/RNA Molecule: Synthetic oligonucleotide
  Description of Artificial Sequence: Synthetic oligonucleotide
aaccacucaaaaacauuugtt

SEQ ID NO: 1059 - DNA, 21 bp, Artificial Sequence
  Description of Combined DNA/RNA Molecule: Synthetic oligonucleotide
  Description of Artificial Sequence: Synthetic oligonucleotide
caaauguuuuugagugguutt

SEQ ID NO: 1060 - DNA, 21 bp, Artificial Sequence
  Description of Combined DNA/RNA Molecule: Synthetic oligonucleotide
  Description of Artificial Sequence: Synthetic oligonucleotide
uuugcaaguuaaugaaucutt

SEQ ID NO: 1061 - DNA, 21 bp, Artificial Sequence
  Description of Combined DNA/RNA Molecule: Synthetic oligonucleotide
  Description of Artificial Sequence: Synthetic oligonucleotide
agauucauuaacuugcaaatt

SEQ ID NO: 1062 - DNA, 21 bp, Artificial Sequence
  Description of Combined DNA/RNA Molecule: Synthetic oligonucleotide
  Description of Artificial Sequence: Synthetic oligonucleotide
uuauuuucaguagucagaatt

SEQ ID NO: 1063 - DNA, 21 bp, Artificial Sequence
  Description of Combined DNA/RNA Molecule: Synthetic oligonucleotide
  Description of Artificial Sequence: Synthetic oligonucleotide
uucugacuacugaaaauaatt

SEQ ID NO: 1064 - DNA, 21 bp, Artificial Sequence
  Description of Combined DNA/RNA Molecule: Synthetic oligonucleotide
  Description of Artificial Sequence: Synthetic oligonucleotide
uuuucucgauucaaaucuutt

SEQ ID NO: 1065 - DNA, 21 bp, Artificial Sequence
  Description of Combined DNA/RNA Molecule: Synthetic oligonucleotide
  Description of Artificial Sequence: Synthetic oligonucleotide
aagauuugaaucgagaaaatt

SEQ ID NO: 1066 - DNA, 21 bp, Artificial Sequence
  Description of Combined DNA/RNA Molecule: Synthetic oligonucleotide
  Description of Artificial Sequence: Synthetic oligonucleotide
guacgaaaagaaguuagugtt

SEQ ID NO: 1067 - DNA, 21 bp, Artificial Sequence
  Description of Combined DNA/RNA Molecule: Synthetic oligonucleotide
  Description of Artificial Sequence: Synthetic oligonucleotide
cacuaacuucuuuucguactt

SEQ ID NO: 1068 - DNA, 21 bp, Artificial Sequence
  Description of Combined DNA/RNA Molecule: Synthetic oligonucleotide
  Description of Artificial Sequence: Synthetic oligonucleotide
uuuaaaacgagaucuugcutt

SEQ ID NO: 1069 - DNA, 21 bp, Artificial Sequence
  Description of Combined DNA/RNA Molecule: Synthetic oligonucleotide
  Description of Artificial Sequence: Synthetic oligonucleotide
agcaagaucucguuuuaaatt

SEQ ID NO: 1070 - DNA, 21 bp, Artificial Sequence
  Description of Combined DNA/RNA Molecule: Synthetic oligonucleotide
  Description of Artificial Sequence: Synthetic oligonucleotide
gaauugauuaauguacucatt

SEQ ID NO: 1071 - DNA, 21 bp, Artificial Sequence
  Description of Combined DNA/RNA Molecule: Synthetic oligonucleotide
  Description of Artificial Sequence: Synthetic oligonucleotide
ugaguacauuaaucaauuctt

SEQ ID NO: 1072 - DNA, 21 bp, Artificial Sequence
  Description of Combined DNA/RNA Molecule: Synthetic oligonucleotide
  Description of Artificial Sequence: Synthetic oligonucleotide
gauggacguaaggcagcuctt

SEQ ID NO: 1073 - DNA, 21 bp, Artificial Sequence
  Description of Combined DNA/RNA Molecule: Synthetic oligonucleotide
  Description of Artificial Sequence: Synthetic oligonucleotide
gagcugccuuacguccauctt

SEQ ID NO: 1074 - DNA, 21 bp, Artificial Sequence
  Description of Combined DNA/RNA Molecule: Synthetic oligonucleotide
  Description of Artificial Sequence: Synthetic oligonucleotide
caucugacuaauggcucugtt

SEQ ID NO: 1075 - DNA, 21 bp, Artificial Sequence
  Description of Combined DNA/RNA Molecule: Synthetic oligonucleotide
  Description of Artificial Sequence: Synthetic oligonucleotide
cagagccauuagucagaugtt

SEQ ID NO: 1076 - DNA, 21 bp, Artificial Sequence
  Description of Combined DNA/RNA Molecule: Synthetic oligonucleotide
  Description of Artificial Sequence: Synthetic oligonucleotide
gugauccuguacgaaaagatt

SEQ ID NO: 1077 - DNA, 21 bp, Artificial Sequence
  Description of Combined DNA/RNA Molecule: Synthetic oligonucleotide
  Description of Artificial Sequence: Synthetic oligonucleotide
ucuuuucguacaggaucactt

SEQ ID NO: 1078 - DNA, 21 bp, Artificial Sequence
  Description of Combined DNA/RNA Molecule: Synthetic oligonucleotide
  Description of Artificial Sequence: Synthetic oligonucleotide
agcucuuauuaaggaguautt

SEQ ID NO: 1079 - DNA, 21 bp, Artificial Sequence
  Description of Combined DNA/RNA Molecule: Synthetic oligonucleotide
  Description of Artificial Sequence: Synthetic oligonucleotide
auacuccuuaauaagagcutt

SEQ ID NO: 1080 - DNA, 21 bp, Artificial Sequence
  Description of Combined DNA/RNA Molecule: Synthetic oligonucleotide
  Description of Artificial Sequence: Synthetic oligonucleotide
gcucuuauuaaggaguauatt

SEQ ID NO: 1081 - DNA, 21 bp, Artificial Sequence
  Description of Combined DNA/RNA Molecule: Synthetic oligonucleotide
  Description of Artificial Sequence: Synthetic oligonucleotide
uauacuccuuaauaagagctt

SEQ ID NO: 1082 - DNA, 21 bp, Artificial Sequence
  Description of Combined DNA/RNA Molecule: Synthetic oligonucleotide
  Description of Artificial Sequence: Synthetic oligonucleotide
ucuuauuaaggaguauacgtt

SEQ ID NO: 1083 - DNA, 21 bp, Artificial Sequence
  Description of Combined DNA/RNA Molecule: Synthetic oligonucleotide
  Description of Artificial Sequence: Synthetic oligonucleotide
cguauacuccuuaauaagatt

SEQ ID NO: 1084 - DNA, 21 bp, Artificial Sequence
  Description of Combined DNA/RNA Molecule: Synthetic oligonucleotide
  Description of Artificial Sequence: Synthetic oligonucleotide
uauuaaggaguauacggagtt

SEQ ID NO: 1085 - DNA, 21 bp, Artificial Sequence
  Description of Combined DNA/RNA Molecule: Synthetic oligonucleotide
  Description of Artificial Sequence: Synthetic oligonucleotide
cuccguauacuccuuaauatt

SEQ ID NO: 1086 - DNA, 21 bp, Artificial Sequence
  Description of Combined DNA/RNA Molecule: Synthetic oligonucleotide
  Description of Artificial Sequence: Synthetic oligonucleotide
cugcagcccgugagaaaaatt

SEQ ID NO: 1087 - DNA, 21 bp, Artificial Sequence
  Description of Combined DNA/RNA Molecule: Synthetic oligonucleotide
  Description of Artificial Sequence: Synthetic oligonucleotide
uuuuucucacgggcugcagtt

SEQ ID NO: 1088 - DNA, 21 bp, Artificial Sequence
  Description of Combined DNA/RNA Molecule: Synthetic oligonucleotide
  Description of Artificial Sequence: Synthetic oligonucleotide
ucaagacugaucuucuaagtt

SEQ ID NO: 1089 - DNA, 21 bp, Artificial Sequence
  Description of Combined DNA/RNA Molecule: Synthetic oligonucleotide
  Description of Artificial Sequence: Synthetic oligonucleotide
cuuagaagaucagucuugatt

SEQ ID NO: 1090 - DNA, 21 bp, Artificial Sequence
  Description of Combined DNA/RNA Molecule: Synthetic oligonucleotide
  Description of Artificial Sequence: Synthetic oligonucleotide
cuucuaaguucacuggaaatt

SEQ ID NO: 1091 - DNA, 21 bp, Artificial Sequence
  Description of Combined DNA/RNA Molecule: Synthetic oligonucleotide
  Description of Artificial Sequence: Synthetic oligonucleotide
uuuccagugaacuuagaagtt

SEQ ID NO: 1092 - DNA, 21 bp, Artificial Sequence
  Description of Combined DNA/RNA Molecule: Synthetic oligonucleotide
  Description of Artificial Sequence: Synthetic oligonucleotide
ugcaaguuaaugaaucuuutt

SEQ ID NO: 1093 - DNA, 21 bp, Artificial Sequence
  Description of Combined DNA/RNA Molecule: Synthetic oligonucleotide
  Description of Artificial Sequence: Synthetic oligonucleotide
aaagauucauuaacuugcatt

SEQ ID NO: 1094 - DNA, 21 bp, Artificial Sequence
  Description of Combined DNA/RNA Molecule: Synthetic oligonucleotide
  Description of Artificial Sequence: Synthetic oligonucleotide
aaucuaaggauauagucaatt

SEQ ID NO: 1095 - DNA, 21 bp, Artificial Sequence
  Description of Combined DNA/RNA Molecule: Synthetic oligonucleotide
  Description of Artificial Sequence: Synthetic oligonucleotide
uugacuauauccuuagauutt

SEQ ID NO: 1096 - DNA, 21 bp, Artificial Sequence
  Description of Combined DNA/RNA Molecule: Synthetic oligonucleotide
  Description of Artificial Sequence: Synthetic oligonucleotide
aucucugaacacaagaacatt

SEQ ID NO: 1097 - DNA, 21 bp, Artificial Sequence
  Description of Combined DNA/RNA Molecule: Synthetic oligonucleotide
  Description of Artificial Sequence: Synthetic oligonucleotide
uguucuuguguucagagautt

SEQ ID NO: 1098 - DNA, 21 bp, Artificial Sequence
  Description of Combined DNA/RNA Molecule: Synthetic oligonucleotide
  Description of Artificial Sequence: Synthetic oligonucleotide
uucugaacaguggguaucutt

SEQ ID NO: 1099 - DNA, 21 bp, Artificial Sequence
  Description of Combined DNA/RNA Molecule: Synthetic oligonucleotide
  Description of Artificial Sequence: Synthetic oligonucleotide
agauacccacuguucagaatt

SEQ ID NO: 1100 - DNA, 21 bp, Artificial Sequence
  Description of Combined DNA/RNA Molecule: Synthetic oligonucleotide
  Description of Artificial Sequence: Synthetic oligonucleotide
aguuauuuauacccaucaatt

SEQ ID NO: 1101 - DNA, 21 bp, Artificial Sequence
  Description of Combined DNA/RNA Molecule: Synthetic oligonucleotide
  Description of Artificial Sequence: Synthetic oligonucleotide
uugauggguauaaauaacutt

SEQ ID NO: 1102 - DNA, 21 bp, Artificial Sequence
  Description of Combined DNA/RNA Molecule: Synthetic oligonucleotide
  Description of Artificial Sequence: Synthetic oligonucleotide
augcuaaacuguucagaaatt

SEQ ID NO: 1103 - DNA, 21 bp, Artificial Sequence
  Description of Combined DNA/RNA Molecule: Synthetic oligonucleotide
  Description of Artificial Sequence: Synthetic oligonucleotide
uuucugaacaguuuagcautt

SEQ ID NO: 1104 - DNA, 21 bp, Artificial Sequence
  Description of Combined DNA/RNA Molecule: Synthetic oligonucleotide
  Description of Artificial Sequence: Synthetic oligonucleotide
cuacagagcacuugguuactt

SEQ ID NO: 1105 - DNA, 21 bp, Artificial Sequence
  Description of Combined DNA/RNA Molecule: Synthetic oligonucleotide
  Description of Artificial Sequence: Synthetic oligonucleotide
guaaccaagugcucuguagtt

SEQ ID NO: 1106 - DNA, 21 bp, Artificial Sequence
  Description of Combined DNA/RNA Molecule: Synthetic oligonucleotide
  Description of Artificial Sequence: Synthetic oligonucleotide
uauauaucagccgggcgcgtt

SEQ ID NO: 1107 - DNA, 21 bp, Artificial Sequence
  Description of Combined DNA/RNA Molecule: Synthetic oligonucleotide
  Description of Artificial Sequence: Synthetic oligonucleotide
cgcgcccggcugauauauatt

SEQ ID NO: 1108 - DNA, 21 bp, Artificial Sequence
  Description of Combined DNA/RNA Molecule: Synthetic oligonucleotide
  Description of Artificial Sequence: Synthetic oligonucleotide
auguaaauacguauuucuatt

SEQ ID NO: 1109 - DNA, 21 bp, Artificial Sequence
  Description of Combined DNA/RNA Molecule: Synthetic oligonucleotide
  Description of Artificial Sequence: Synthetic oligonucleotide
uagaaauacguauuuacautt

SEQ ID NO: 1110 - DNA, 21 bp, Artificial Sequence
  Description of Combined DNA/RNA Molecule: Synthetic oligonucleotide
  Description of Artificial Sequence: Synthetic oligonucleotide
uuuuucucgauucaaaucutt

SEQ ID NO: 1111 - DNA, 21 bp, Artificial Sequence
  Description of Combined DNA/RNA Molecule: Synthetic oligonucleotide
  Description of Artificial Sequence: Synthetic oligonucleotide
agauuugaaucgagaaaaatt

SEQ ID NO: 1112 - DNA, 21 bp, Artificial Sequence
  Description of Combined DNA/RNA Molecule: Synthetic oligonucleotide
  Description of Artificial Sequence: Synthetic oligonucleotide
aaucuuaacccuuaggacutt

SEQ ID NO: 1113 - DNA, 21 bp, Artificial Sequence
  Description of Combined DNA/RNA Molecule: Synthetic oligonucleotide
  Description of Artificial Sequence: Synthetic oligonucleotide
aguccuaaggguuaagauutt

SEQ ID NO: 1114 - DNA, 21 bp, Artificial Sequence
  Description of Combined DNA/RNA Molecule: Synthetic oligonucleotide
  Description of Artificial Sequence: Synthetic oligonucleotide
ccuuaggacucugguauuutt

SEQ ID NO: 1115 - DNA, 21 bp, Artificial Sequence
  Description of Combined DNA/RNA Molecule: Synthetic oligonucleotide
  Description of Artificial Sequence: Synthetic oligonucleotide
aaauaccagaguccuaaggtt

SEQ ID NO: 1116 - DNA, 21 bp, Artificial Sequence
  Description of Combined DNA/RNA Molecule: Synthetic oligonucleotide
  Description of Artificial Sequence: Synthetic oligonucleotide
aauaaacugcccucaguaatt

SEQ ID NO: 1117 - DNA, 21 bp, Artificial Sequence
  Description of Combined DNA/RNA Molecule: Synthetic oligonucleotide
  Description of Artificial Sequence: Synthetic oligonucleotide
uuacugagggcaguuuauutt

SEQ ID NO: 1118 - DNA, 21 bp, Artificial Sequence
  Description of Combined DNA/RNA Molecule: Synthetic oligonucleotide
  Description of Artificial Sequence: Synthetic oligonucleotide
gauccuguacgaaaagaagtt

SEQ ID NO: 1119 - DNA, 21 bp, Artificial Sequence
  Description of Combined DNA/RNA Molecule: Synthetic oligonucleotide
  Description of Artificial Sequence: Synthetic oligonucleotide
cuucuuuucguacaggauctt

SEQ ID NO: 1120 - DNA, 21 bp, Artificial Sequence
  Description of Combined DNA/RNA Molecule: Synthetic oligonucleotide
  Description of Artificial Sequence: Synthetic oligonucleotide
aaugugauccuguacgaaatt

SEQ ID NO: 1121 - DNA, 21 bp, Artificial Sequence
  Description of Combined DNA/RNA Molecule: Synthetic oligonucleotide
  Description of Artificial Sequence: Synthetic oligonucleotide
uuucguacaggaucacauutt

SEQ ID NO: 1122 - DNA, 21 bp, Artificial Sequence
  Description of Combined DNA/RNA Molecule: Synthetic oligonucleotide
  Description of Artificial Sequence: Synthetic oligonucleotide
gugaaaacauuggccguuctt

SEQ ID NO: 1123 - DNA, 21 bp, Artificial Sequence
  Description of Combined DNA/RNA Molecule: Synthetic oligonucleotide
  Description of Artificial Sequence: Synthetic oligonucleotide
gaacggccaauguuuucactt

SEQ ID NO: 1124 - DNA, 21 bp, Artificial Sequence
  Description of Combined DNA/RNA Molecule: Synthetic oligonucleotide
  Description of Artificial Sequence: Synthetic oligonucleotide
cuugaggaaacucugaguatt

SEQ ID NO: 1125 - DNA, 21 bp, Artificial Sequence
  Description of Combined DNA/RNA Molecule: Synthetic oligonucleotide
  Description of Artificial Sequence: Synthetic oligonucleotide
uacucagaguuuccucaagtt

SEQ ID NO: 1126 - DNA, 21 bp, Artificial Sequence
  Description of Combined DNA/RNA Molecule: Synthetic oligonucleotide
  Description of Artificial Sequence: Synthetic oligonucleotide
cguuuaaaacgagaucuugtt

SEQ ID NO: 1127 - DNA, 21 bp, Artificial Sequence
  Description of Combined DNA/RNA Molecule: Synthetic oligonucleotide
  Description of Artificial Sequence: Synthetic oligonucleotide
caagaucucguuuuaaacgtt

SEQ ID NO: 1128 - DNA, 21 bp, Artificial Sequence
  Description of Combined DNA/RNA Molecule: Synthetic oligonucleotide
  Description of Artificial Sequence: Synthetic oligonucleotide
uuaaaacgagaucuugcugtt

SEQ ID NO: 1129 - DNA, 21 bp, Artificial Sequence
  Description of Combined DNA/RNA Molecule: Synthetic oligonucleotide
  Description of Artificial Sequence: Synthetic oligonucleotide
cagcaagaucucguuuuaatt

SEQ ID NO: 1130 - DNA, 21 bp, Artificial Sequence
  Description of Combined DNA/RNA Molecule: Synthetic oligonucleotide
  Description of Artificial Sequence: Synthetic oligonucleotide
aaagauguaucuggucucctt

SEQ ID NO: 1131 - DNA, 21 bp, Artificial Sequence
  Description of Combined DNA/RNA Molecule: Synthetic oligonucleotide
  Description of Artificial Sequence: Synthetic oligonucleotide
ggagaccagauacaucuuutt

SEQ ID NO: 1132 - DNA, 21 bp, Artificial Sequence
  Description of Combined DNA/RNA Molecule: Synthetic oligonucleotide
  Description of Artificial Sequence: Synthetic oligonucleotide
cagaaaaugugucuacucatt

SEQ ID NO: 1133 - DNA, 21 bp, Artificial Sequence
  Description of Combined DNA/RNA Molecule: Synthetic oligonucleotide
  Description of Artificial Sequence: Synthetic oligonucleotide
ugaguagacacauuuucugtt

SEQ ID NO: 1134 - DNA, 21 bp, Artificial Sequence
  Description of Combined DNA/RNA Molecule: Synthetic oligonucleotide
  Description of Artificial Sequence: Synthetic oligonucleotide
caggaauugauuaauguactt

SEQ ID NO: 1135 - DNA, 21 bp, Artificial Sequence
  Description of Combined DNA/RNA Molecule: Synthetic oligonucleotide
  Description of Artificial Sequence: Synthetic oligonucleotide
guacauuaaucaauuccugtt

SEQ ID NO: 1136 - DNA, 21 bp, Artificial Sequence
  Description of Combined DNA/RNA Molecule: Synthetic oligonucleotide
  Description of Artificial Sequence: Synthetic oligonucleotide
agucaacuaaagcauauuutt

SEQ ID NO: 1137 - DNA, 21 bp, Artificial Sequence
  Description of Combined DNA/RNA Molecule: Synthetic oligonucleotide
  Description of Artificial Sequence: Synthetic oligonucleotide
aaauaugcuuuaguugacutt

SEQ ID NO: 1138 - DNA, 21 bp, Artificial Sequence
  Description of Combined DNA/RNA Molecule: Synthetic oligonucleotide
  Description of Artificial Sequence: Synthetic oligonucleotide
uguguaacaaucuacaugatt

SEQ ID NO: 1139 - DNA, 21 bp, Artificial Sequence
  Description of Combined DNA/RNA Molecule: Synthetic oligonucleotide
  Description of Artificial Sequence: Synthetic oligonucleotide
ucauguagauuguuacacatt

SEQ ID NO: 1140 - DNA, 21 bp, Artificial Sequence
  Description of Combined DNA/RNA Molecule: Synthetic oligonucleotide
  Description of Artificial Sequence: Synthetic oligonucleotide
auaccauuuguuccuuggutt

SEQ ID NO: 1141 - DNA, 21 bp, Artificial Sequence
  Description of Combined DNA/RNA Molecule: Synthetic oligonucleotide
  Description of Artificial Sequence: Synthetic oligonucleotide
accaaggaacaaaugguautt

SEQ ID NO: 1142 - DNA, 21 bp, Artificial Sequence
  Description of Combined DNA/RNA Molecule: Synthetic oligonucleotide
  Description of Artificial Sequence: Synthetic oligonucleotide
gcagaaaucuaaggauauatt

SEQ ID NO: 1143 - DNA, 21 bp, Artificial Sequence
  Description of Combined DNA/RNA Molecule: Synthetic oligonucleotide
  Description of Artificial Sequence: Synthetic oligonucleotide
uauauccuuagauuucugctt

SEQ ID NO: 1144 - DNA, 21 bp, Artificial Sequence
  Description of Combined DNA/RNA Molecule: Synthetic oligonucleotide
  Description of Artificial Sequence: Synthetic oligonucleotide
uggcuucucacaggaacuctt

SEQ ID NO: 1145 - DNA, 21 bp, Artificial Sequence
  Description of Combined DNA/RNA Molecule: Synthetic oligonucleotide
  Description of Artificial Sequence: Synthetic oligonucleotide
gaguuccugugagaagccatt

SEQ ID NO: 1146 - DNA, 21 bp, Artificial Sequence
  Description of Combined DNA/RNA Molecule: Synthetic oligonucleotide
  Description of Artificial Sequence: Synthetic oligonucleotide
gagaugugaaucucugaactt

SEQ ID NO: 1147 - DNA, 21 bp, Artificial Sequence
  Description of Combined DNA/RNA Molecule: Synthetic oligonucleotide
  Description of Artificial Sequence: Synthetic oligonucleotide
guucagagauucacaucuctt

SEQ ID NO: 1148 - DNA, 21 bp, Artificial Sequence
  Description of Combined DNA/RNA Molecule: Synthetic oligonucleotide
  Description of Artificial Sequence: Synthetic oligonucleotide
uguaagccaauguugugagtt

SEQ ID NO: 1149 - DNA, 21 bp, Artificial Sequence
  Description of Combined DNA/RNA Molecule: Synthetic oligonucleotide
  Description of Artificial Sequence: Synthetic oligonucleotide
cucacaacauuggcuuacatt

SEQ ID NO: 1150 - DNA, 21 bp, Artificial Sequence
  Description of Combined DNA/RNA Molecule: Synthetic oligonucleotide
  Description of Artificial Sequence: Synthetic oligonucleotide
agccaauguugugaggcuutt

SEQ ID NO: 1151 - DNA, 21 bp, Artificial Sequence
  Description of Combined DNA/RNA Molecule: Synthetic oligonucleotide
  Description of Artificial Sequence: Synthetic oligonucleotide
aagccucacaacauuggcutt

SEQ ID NO: 1152 - DNA, 21 bp, Artificial Sequence
  Description of Combined DNA/RNA Molecule: Synthetic oligonucleotide
  Description of Artificial Sequence: Synthetic oligonucleotide
uugugaggcuucaaguucatt

SEQ ID NO: 1153 - DNA, 21 bp, Artificial Sequence
  Description of Combined DNA/RNA Molecule: Synthetic oligonucleotide
  Description of Artificial Sequence: Synthetic oligonucleotide
ugaacuugaagccucacaatt

SEQ ID NO: 1154 - DNA, 21 bp, Artificial Sequence
  Description of Combined DNA/RNA Molecule: Synthetic oligonucleotide
  Description of Artificial Sequence: Synthetic oligonucleotide
aggcagcucaugagaaacatt

SEQ ID NO: 1155 - DNA, 21 bp, Artificial Sequence
  Description of Combined DNA/RNA Molecule: Synthetic oligonucleotide
  Description of Artificial Sequence: Synthetic oligonucleotide
uguuucucaugagcugccutt

SEQ ID NO: 1156 - DNA, 21 bp, Artificial Sequence
  Description of Combined DNA/RNA Molecule: Synthetic oligonucleotide
  Description of Artificial Sequence: Synthetic oligonucleotide
auaaauugauagcacaaaatt

SEQ ID NO: 1157 - DNA, 21 bp, Artificial Sequence
  Description of Combined DNA/RNA Molecule: Synthetic oligonucleotide
  Description of Artificial Sequence: Synthetic oligonucleotide
uuuugugcuaucaauuuautt

SEQ ID NO: 1158 - DNA, 21 bp, Artificial Sequence
  Description of Combined DNA/RNA Molecule: Synthetic oligonucleotide
  Description of Artificial Sequence: Synthetic oligonucleotide
acaaaaucuagaacuuaautt

SEQ ID NO: 1159 - DNA, 21 bp, Artificial Sequence
  Description of Combined DNA/RNA Molecule: Synthetic oligonucleotide
  Description of Artificial Sequence: Synthetic oligonucleotide
auuaaguucuagauuuugutt

SEQ ID NO: 1160 - DNA, 21 bp, Artificial Sequence
  Description of Combined DNA/RNA Molecule: Synthetic oligonucleotide
  Description of Artificial Sequence: Synthetic oligonucleotide
gauaucccaacagguacgatt

SEQ ID NO: 1161 - DNA, 21 bp, Artificial Sequence
  Description of Combined DNA/RNA Molecule: Synthetic oligonucleotide
  Description of Artificial Sequence: Synthetic oligonucleotide
ucguaccuguugggauauctt

SEQ ID NO: 1162 - DNA, 21 bp, Artificial Sequence
  Description of Combined DNA/RNA Molecule: Synthetic oligonucleotide
  Description of Artificial Sequence: Synthetic oligonucleotide
aaguuauuuauacccaucatt

SEQ ID NO: 1163 - DNA, 21 bp, Artificial Sequence
  Description of Combined DNA/RNA Molecule: Synthetic oligonucleotide
  Description of Artificial Sequence: Synthetic oligonucleotide
ugauggguauaaauaacuutt

SEQ ID NO: 1164 - DNA, 21 bp, Artificial Sequence
  Description of Combined DNA/RNA Molecule: Synthetic oligonucleotide
  Description of Artificial Sequence: Synthetic oligonucleotide
uguaaauacguauuucuagtt

SEQ ID NO: 1165 - DNA, 21 bp, Artificial Sequence
  Description of Combined DNA/RNA Molecule: Synthetic oligonucleotide
  Description of Artificial Sequence: Synthetic oligonucleotide
cuagaaauacguauuuacatt

SEQ ID NO: 1166 - DNA, 21 bp, Artificial Sequence
  Description of Combined DNA/RNA Molecule: Synthetic oligonucleotide
  Description of Artificial Sequence: Synthetic oligonucleotide
ucuaguuuucauauaaagutt

SEQ ID NO: 1167 - DNA, 21 bp, Artificial Sequence
  Description of Combined DNA/RNA Molecule: Synthetic oligonucleotide
  Description of Artificial Sequence: Synthetic oligonucleotide
acuuuauaugaaaacuagatt

SEQ ID NO: 1168 - DNA, 21 bp, Artificial Sequence
  Description of Combined DNA/RNA Molecule: Synthetic oligonucleotide
  Description of Artificial Sequence: Synthetic oligonucleotide
auaaaguaguucuuuuauatt

SEQ ID NO: 1169 - DNA, 21 bp, Artificial Sequence
  Description of Combined DNA/RNA Molecule: Synthetic oligonucleotide
  Description of Artificial Sequence: Synthetic oligonucleotide
uauaaaagaacuacuuuautt

SEQ ID NO: 1170 - DNA, 21 bp, Artificial Sequence
  Description of Combined DNA/RNA Molecule: Synthetic oligonucleotide
  Description of Artificial Sequence: Synthetic oligonucleotide
ccauuuguagagcuacaaatt

SEQ ID NO: 1171 - DNA, 21 bp, Artificial Sequence
  Description of Combined DNA/RNA Molecule: Synthetic oligonucleotide
  Description of Artificial Sequence: Synthetic oligonucleotide
uuuguagcucuacaaauggtt

SEQ ID NO: 1172 - DNA, 21 bp, Artificial Sequence
  Description of Combined DNA/RNA Molecule: Synthetic oligonucleotide
  Description of Artificial Sequence: Synthetic oligonucleotide
uauuuucaguagucagaautt

SEQ ID NO: 1173 - DNA, 21 bp, Artificial Sequence
  Description of Combined DNA/RNA Molecule: Synthetic oligonucleotide
  Description of Artificial Sequence: Synthetic oligonucleotide
auucugacuacugaaaauatt

SEQ ID NO: 1174 - DNA, 21 bp, Artificial Sequence
  Description of Combined DNA/RNA Molecule: Synthetic oligonucleotide
  Description of Artificial Sequence: Synthetic oligonucleotide
aaaucuaacccuaguuguatt

SEQ ID NO: 1175 - DNA, 21 bp, Artificial Sequence
  Description of Combined DNA/RNA Molecule: Synthetic oligonucleotide
  Description of Artificial Sequence: Synthetic oligonucleotide
uacaacuaggguuagauuutt

SEQ ID NO: 1176 - DNA, 21 bp, Artificial Sequence
  Description of Combined DNA/RNA Molecule: Synthetic oligonucleotide
  Description of Artificial Sequence: Synthetic oligonucleotide
cuuuagaguauacauugcutt

SEQ ID NO: 1177 - DNA, 21 bp, Artificial Sequence
  Description of Combined DNA/RNA Molecule: Synthetic oligonucleotide
  Description of Artificial Sequence: Synthetic oligonucleotide
agcaauguauacucuaaagtt

SEQ ID NO: 1178 - DNA, 21 bp, Artificial Sequence
  Description of Combined DNA/RNA Molecule: Synthetic oligonucleotide
  Description of Artificial Sequence: Synthetic oligonucleotide
aucugacuaauggcucugutt

SEQ ID NO: 1179 - DNA, 21 bp, Artificial Sequence
  Description of Combined DNA/RNA Molecule: Synthetic oligonucleotide
  Description of Artificial Sequence: Synthetic oligonucleotide
acagagccauuagucagautt

SEQ ID NO: 1180 - DNA, 21 bp, Artificial Sequence
  Description of Combined DNA/RNA Molecule: Synthetic oligonucleotide
  Description of Artificial Sequence: Synthetic oligonucleotide
cacaaugauuuaaggacugtt

SEQ ID NO: 1181 - DNA, 21 bp, Artificial Sequence
  Description of Combined DNA/RNA Molecule: Synthetic oligonucleotide
  Description of Artificial Sequence: Synthetic oligonucleotide
caguccuuaaaucauugugtt

SEQ ID NO: 1182 - DNA, 21 bp, Artificial Sequence
  Description of Combined DNA/RNA Molecule: Synthetic oligonucleotide
  Description of Artificial Sequence: Synthetic oligonucleotide
ucuuuuucucgauucaaautt

SEQ ID NO: 1183 - DNA, 21 bp, Artificial Sequence
  Description of Combined DNA/RNA Molecule: Synthetic oligonucleotide
  Description of Artificial Sequence: Synthetic oligonucleotide
auuugaaucgagaaaaagatt

SEQ ID NO: 1184 - DNA, 21 bp, Artificial Sequence
  Description of Combined DNA/RNA Molecule: Synthetic oligonucleotide
  Description of Artificial Sequence: Synthetic oligonucleotide
cuuuuucucgauucaaauctt

SEQ ID NO: 1185 - DNA, 21 bp, Artificial Sequence
  Description of Combined DNA/RNA Molecule: Synthetic oligonucleotide
  Description of Artificial Sequence: Synthetic oligonucleotide
gauuugaaucgagaaaaagtt

SEQ ID NO: 1186 - DNA, 21 bp, Artificial Sequence
  Description of Combined DNA/RNA Molecule: Synthetic oligonucleotide
  Description of Artificial Sequence: Synthetic oligonucleotide
auuuucugcucacgaugagtt

SEQ ID NO: 1187 - DNA, 21 bp, Artificial Sequence
  Description of Combined DNA/RNA Molecule: Synthetic oligonucleotide
  Description of Artificial Sequence: Synthetic oligonucleotide
cucaucgugagcagaaaautt

SEQ ID NO: 1188 - DNA, 21 bp, Artificial Sequence
  Description of Combined DNA/RNA Molecule: Synthetic oligonucleotide
  Description of Artificial Sequence: Synthetic oligonucleotide
uuucugcucacgaugaguutt

SEQ ID NO: 1189 - DNA, 21 bp, Artificial Sequence
  Description of Combined DNA/RNA Molecule: Synthetic oligonucleotide
  Description of Artificial Sequence: Synthetic oligonucleotide
aacucaucgugagcagaaatt

SEQ ID NO: 1190 - DNA, 21 bp, Artificial Sequence
  Description of Combined DNA/RNA Molecule: Synthetic oligonucleotide
  Description of Artificial Sequence: Synthetic oligonucleotide
agagcuacaaaaccuaucctt

SEQ ID NO: 1191 - DNA, 21 bp, Artificial Sequence
  Description of Combined DNA/RNA Molecule: Synthetic oligonucleotide
  Description of Artificial Sequence: Synthetic oligonucleotide
ggauagguuuuguagcucutt

SEQ ID NO: 1192 - DNA, 21 bp, Artificial Sequence
  Description of Combined DNA/RNA Molecule: Synthetic oligonucleotide
  Description of Artificial Sequence: Synthetic oligonucleotide
gagccaaagguacaccacutt

SEQ ID NO: 1193 - DNA, 21 bp, Artificial Sequence
  Description of Combined DNA/RNA Molecule: Synthetic oligonucleotide
  Description of Artificial Sequence: Synthetic oligonucleotide
agugguguaccuuuggcuctt

SEQ ID NO: 1194 - DNA, 21 bp, Artificial Sequence
  Description of Combined DNA/RNA Molecule: Synthetic oligonucleotide
  Description of Artificial Sequence: Synthetic oligonucleotide
gccaaagguacaccacuactt

SEQ ID NO: 1195 - DNA, 21 bp, Artificial Sequence
  Description of Combined DNA/RNA Molecule: Synthetic oligonucleotide
  Description of Artificial Sequence: Synthetic oligonucleotide
guagugguguaccuuuggctt

SEQ ID NO: 1196 - DNA, 21 bp, Artificial Sequence
  Description of Combined DNA/RNA Molecule: Synthetic oligonucleotide
  Description of Artificial Sequence: Synthetic oligonucleotide
gaacuguacucuucucagctt

SEQ ID NO: 1197 - DNA, 21 bp, Artificial Sequence
  Description of Combined DNA/RNA Molecule: Synthetic oligonucleotide
  Description of Artificial Sequence: Synthetic oligonucleotide
gcugagaagaguacaguuctt

SEQ ID NO: 1198 - DNA, 21 bp, Artificial Sequence
  Description of Combined DNA/RNA Molecule: Synthetic oligonucleotide
  Description of Artificial Sequence: Synthetic oligonucleotide
agguaaauaucaccaacautt

SEQ ID NO: 1199 - DNA, 21 bp, Artificial Sequence
  Description of Combined DNA/RNA Molecule: Synthetic oligonucleotide
  Description of Artificial Sequence: Synthetic oligonucleotide
auguuggugauauuuaccutt

SEQ ID NO: 1200 - DNA, 21 bp, Artificial Sequence
  Description of Combined DNA/RNA Molecule: Synthetic oligonucleotide
  Description of Artificial Sequence: Synthetic oligonucleotide
agcuacaaaaccuauccuutt

SEQ ID NO: 1201 - DNA, 21 bp, Artificial Sequence
  Description of Combined DNA/RNA Molecule: Synthetic oligonucleotide
  Description of Artificial Sequence: Synthetic oligonucleotide
aaggauagguuuuguagcutt

SEQ ID NO: 1202 - DNA, 21 bp, Artificial Sequence
  Description of Combined DNA/RNA Molecule: Synthetic oligonucleotide
  Description of Artificial Sequence: Synthetic oligonucleotide
ugugaaagcauuuaauucctt

SEQ ID NO: 1203 - DNA, 21 bp, Artificial Sequence
  Description of Combined DNA/RNA Molecule: Synthetic oligonucleotide
  Description of Artificial Sequence: Synthetic oligonucleotide
ggaauuaaaugcuuucacatt

SEQ ID NO: 1204 - DNA, 21 bp, Artificial Sequence
  Description of Combined DNA/RNA Molecule: Synthetic oligonucleotide
  Description of Artificial Sequence: Synthetic oligonucleotide
gcccacuuuagaguauacatt

SEQ ID NO: 1205 - DNA, 21 bp, Artificial Sequence
  Description of Combined DNA/RNA Molecule: Synthetic oligonucleotide
  Description of Artificial Sequence: Synthetic oligonucleotide
uguauacucuaaagugggctt

SEQ ID NO: 1206 - DNA, 21 bp, Artificial Sequence
  Description of Combined DNA/RNA Molecule: Synthetic oligonucleotide
  Description of Artificial Sequence: Synthetic oligonucleotide
ugugccacacuccaagacctt

SEQ ID NO: 1207 - DNA, 21 bp, Artificial Sequence
  Description of Combined DNA/RNA Molecule: Synthetic oligonucleotide
  Description of Artificial Sequence: Synthetic oligonucleotide
ggucuuggaguguggcacatt

SEQ ID NO: 1208 - DNA, 21 bp, Artificial Sequence
  Description of Combined DNA/RNA Molecule: Synthetic oligonucleotide
  Description of Artificial Sequence: Synthetic oligonucleotide
aaacuaaauugaucucguatt

SEQ ID NO: 1209 - DNA, 21 bp, Artificial Sequence
  Description of Combined DNA/RNA Molecule: Synthetic oligonucleotide
  Description of Artificial Sequence: Synthetic oligonucleotide
uacgagaucaauuuaguuutt

SEQ ID NO: 1210 - DNA, 21 bp, Artificial Sequence
  Description of Combined DNA/RNA Molecule: Synthetic oligonucleotide
  Description of Artificial Sequence: Synthetic oligonucleotide
ugaucucguagaauuaucutt

SEQ ID NO: 1211 - DNA, 21 bp, Artificial Sequence
  Description of Combined DNA/RNA Molecule: Synthetic oligonucleotide
  Description of Artificial Sequence: Synthetic oligonucleotide
agauaauucuacgagaucatt

SEQ ID NO: 1212 - DNA, 21 bp, Artificial Sequence
  Description of Combined DNA/RNA Molecule: Synthetic oligonucleotide
  Description of Artificial Sequence: Synthetic oligonucleotide
gcgugcagucgguccuccatt

SEQ ID NO: 1213 - DNA, 21 bp, Artificial Sequence
  Description of Combined DNA/RNA Molecule: Synthetic oligonucleotide
  Description of Artificial Sequence: Synthetic oligonucleotide
uggaggaccgacugcacgctt

SEQ ID NO: 1214 - DNA, 21 bp, Artificial Sequence
  Description of Combined DNA/RNA Molecule: Synthetic oligonucleotide
  Description of Artificial Sequence: Synthetic oligonucleotide
aaaguuuagagacaucugatt

SEQ ID NO: 1215 - DNA, 21 bp, Artificial Sequence
  Description of Combined DNA/RNA Molecule: Synthetic oligonucleotide
  Description of Artificial Sequence: Synthetic oligonucleotide
ucagaugucucuaaacuuutt

SEQ ID NO: 1216 - DNA, 21 bp, Artificial Sequence
  Description of Combined DNA/RNA Molecule: Synthetic oligonucleotide
  Description of Artificial Sequence: Synthetic oligonucleotide
cagaaggaauauguacaaatt

SEQ ID NO: 1217 - DNA, 21 bp, Artificial Sequence
  Description of Combined DNA/RNA Molecule: Synthetic oligonucleotide
  Description of Artificial Sequence: Synthetic oligonucleotide
uuuguacauauuccuucugtt

SEQ ID NO: 1218 - DNA, 21 bp, Artificial Sequence
  Description of Combined DNA/RNA Molecule: Synthetic oligonucleotide
  Description of Artificial Sequence: Synthetic oligonucleotide
cgcccgagaguaccagggatt

SEQ ID NO: 1219 - DNA, 21 bp, Artificial Sequence
  Description of Combined DNA/RNA Molecule: Synthetic oligonucleotide
  Description of Artificial Sequence: Synthetic oligonucleotide
ucccugguacucucgggcgtt

SEQ ID NO: 1220 - DNA, 21 bp, Artificial Sequence
  Description of Combined DNA/RNA Molecule: Synthetic oligonucleotide
  Description of Artificial Sequence: Synthetic oligonucleotide
cggaggagauagaacguuutt

SEQ ID NO: 1221 - DNA, 21 bp, Artificial Sequence
  Description of Combined DNA/RNA Molecule: Synthetic oligonucleotide
  Description of Artificial Sequence: Synthetic oligonucleotide
aaacguucuaucuccuccgtt

SEQ ID NO: 1222 - DNA, 21 bp, Artificial Sequence
  Description of Combined DNA/RNA Molecule: Synthetic oligonucleotide
  Description of Artificial Sequence: Synthetic oligonucleotide
agauagaacguuuaaaacgtt

SEQ ID NO: 1223 - DNA, 21 bp, Artificial Sequence
  Description of Combined DNA/RNA Molecule: Synthetic oligonucleotide
  Description of Artificial Sequence: Synthetic oligonucleotide
cguuuuaaacguucuaucutt

SEQ ID NO: 1224 - DNA, 21 bp, Artificial Sequence
  Description of Combined DNA/RNA Molecule: Synthetic oligonucleotide
  Description of Artificial Sequence: Synthetic oligonucleotide
ggaacaggaacuucacaactt

SEQ ID NO: 1225 - DNA, 21 bp, Artificial Sequence
  Description of Combined DNA/RNA Molecule: Synthetic oligonucleotide
  Description of Artificial Sequence: Synthetic oligonucleotide
guugugaaguuccuguucctt

SEQ ID NO: 1226 - DNA, 21 bp, Artificial Sequence
  Description of Combined DNA/RNA Molecule: Synthetic oligonucleotide
  Description of Artificial Sequence: Synthetic oligonucleotide
gugagccaaagguacaccatt

SEQ ID NO: 1227 - DNA, 21 bp, Artificial Sequence
  Description of Combined DNA/RNA Molecule: Synthetic oligonucleotide
  Description of Artificial Sequence: Synthetic oligonucleotide
ugguguaccuuuggcucactt

SEQ ID NO: 1228 - DNA, 21 bp, Artificial Sequence
  Description of Combined DNA/RNA Molecule: Synthetic oligonucleotide
  Description of Artificial Sequence: Synthetic oligonucleotide
auccucccuagacuucccutt

SEQ ID NO: 1229 - DNA, 21 bp, Artificial Sequence
  Description of Combined DNA/RNA Molecule: Synthetic oligonucleotide
  Description of Artificial Sequence: Synthetic oligonucleotide
agggaagucuagggaggautt

SEQ ID NO: 1230 - DNA, 21 bp, Artificial Sequence
  Description of Combined DNA/RNA Molecule: Synthetic oligonucleotide
  Description of Artificial Sequence: Synthetic oligonucleotide
cacacuccaagaccugugctt

SEQ ID NO: 1231 - DNA, 21 bp, Artificial Sequence
  Description of Combined DNA/RNA Molecule: Synthetic oligonucleotide
  Description of Artificial Sequence: Synthetic oligonucleotide
gcacaggucuuggagugugtt

SEQ ID NO: 1232 - DNA, 21 bp, Artificial Sequence
  Description of Combined DNA/RNA Molecule: Synthetic oligonucleotide
  Description of Artificial Sequence: Synthetic oligonucleotide
acagaaggaauauguacaatt

SEQ ID NO: 1233 - DNA, 21 bp, Artificial Sequence
  Description of Combined DNA/RNA Molecule: Synthetic oligonucleotide
  Description of Artificial Sequence: Synthetic oligonucleotide
uuguacauauuccuucugutt

SEQ ID NO: 1234 - DNA, 21 bp, Artificial Sequence
  Description of Combined DNA/RNA Molecule: Synthetic oligonucleotide
  Description of Artificial Sequence: Synthetic oligonucleotide
uuagagacaucugacuuugtt

SEQ ID NO: 1235 - DNA, 21 bp, Artificial Sequence
  Description of Combined DNA/RNA Molecule: Synthetic oligonucleotide
  Description of Artificial Sequence: Synthetic oligonucleotide
caaagucagaugucucuaatt

SEQ ID NO: 1236 - DNA, 21 bp, Artificial Sequence
  Description of Combined DNA/RNA Molecule: Synthetic oligonucleotide
  Description of Artificial Sequence: Synthetic oligonucleotide
aauugaucucguagaauuatt

SEQ ID NO: 1237 - DNA, 21 bp, Artificial Sequence
  Description of Combined DNA/RNA Molecule: Synthetic oligonucleotide
  Description of Artificial Sequence: Synthetic oligonucleotide
uaauucuacgagaucaauutt

SEQ ID NO: 1238 - DNA, 21 bp, Artificial Sequence
  Description of Combined DNA/RNA Molecule: Synthetic oligonucleotide
  Description of Artificial Sequence: Synthetic oligonucleotide
accgaaguguuguuugucctt

SEQ ID NO: 1239 - DNA, 21 bp, Artificial Sequence
  Description of Combined DNA/RNA Molecule: Synthetic oligonucleotide
  Description of Artificial Sequence: Synthetic oligonucleotide
ggacaaacaacacuucggutt

SEQ ID NO: 1240 - DNA, 21 bp, Artificial Sequence
  Description of Combined DNA/RNA Molecule: Synthetic oligonucleotide
  Description of Artificial Sequence: Synthetic oligonucleotide
ucgagaaucuaaacuaacutt

SEQ ID NO: 1241 - DNA, 21 bp, Artificial Sequence
  Description of Combined DNA/RNA Molecule: Synthetic oligonucleotide
  Description of Artificial Sequence: Synthetic oligonucleotide
aguuaguuuagauucucgatt

SEQ ID NO: 1242 - RNA, 21 nt, Artificial Sequence
  Description of Artificial Sequence: Synthetic oligonucleotide
gcacauaggagagaugagcuu

SEQ ID NO: 1243 - RNA, 23 nt, Artificial Sequence
  Description of Artificial Sequence: Synthetic oligonucleotide
aagcucaucucuccuaugugcug

SEQ ID NO: 1244 - RNA, 23 nt, Homo sapiens
accgaaguguuguuuguccaauu

SEQ ID NO: 1245 - RNA, 23 nt, Homo sapiens
uaugguguuuggagcaucuacua

SEQ ID NO: 1246 - RNA, 23 nt, Homo sapiens
aaucuaaacuaacuagaauccuc

SEQ ID NO: 1247 - RNA, 23 nt, Homo sapiens
uccuuaucgagaaucuaaacuaa

SEQ ID NO: 1248 - RNA, 23 nt, Homo sapiens
gauugauguuuaccgaaguguug

SEQ ID NO: 1249 - RNA, 23 nt, Homo sapiens
uggugagaugcagaccauuuaau

SEQ ID NO: 1250 - RNA, 23 nt, Homo sapiens
acucugaguacauuggaauaugc

SEQ ID NO: 1251 - RNA, 23 nt, Homo sapiens
ccgaaguguuguuuguccaauuc

SEQ ID NO: 1252 - RNA, 23 nt, Homo sapiens
aguuauuaugggcuauaauugca

SEQ ID NO: 1253 - RNA, 23 nt, Homo sapiens
ggaaggugaaaggucaccuaaug

SEQ ID NO: 1254 - RNA, 23 nt, Homo sapiens
uuuuacaauggaaggugaaaggu

SEQ ID NO: 1255 - RNA, 23 nt, Homo sapiens
gaaggugaaaggucaccuaauga

SEQ ID NO: 1256 - RNA, 23 nt, Homo sapiens
aaggugaaaggucaccuaaugaa

SEQ ID NO: 1257 - RNA, 23 nt, Homo sapiens
uuccuuaucgagaaucuaaacua

SEQ ID NO: 1258 - RNA, 23 nt, Homo sapiens
agcucuuauuaaggaguauacgg

SEQ ID NO: 1259 - RNA, 23 nt, Homo sapiens
cagagagauucugugcuuuggag

SEQ ID NO: 1260 - RNA, 23 nt, Homo sapiens
gaaucuaaacuaacuagaauccu

SEQ ID NO: 1261 - RNA, 23 nt, Homo sapiens
acucaccaaaaaagcucuuauua

SEQ ID NO: 1262 - RNA, 23 nt, Homo sapiens
aagagcuuuuugaucuucuuaau

SEQ ID NO: 1263 - RNA, 23 nt, Homo sapiens
ggcguacaagaacaucuauaauu

SEQ ID NO: 1264 - RNA, 23 nt, Homo sapiens
agauugauguuuaccgaaguguu

SEQ ID NO: 1265 - RNA, 23 nt, Homo sapiens
aucuaaacuaacuagaauccucc

SEQ ID NO: 1266 - RNA, 23 nt, Homo sapiens
uuaccgaaguguuguuuguccaa

SEQ ID NO: 1267 - RNA, 23 nt, Homo sapiens
ggugguggugagaugcagaccau

SEQ ID NO: 1268 - RNA, 19 nt, Homo sapiens
cauacucuagucguuccca

SEQ ID NO: 1269 - RNA, 19 nt, Homo sapiens
agcgcccauucaauaguag

SEQ ID NO: 1270 - RNA, 19 nt, Homo sapiens
ggaaagcuagcgcccauuc

SEQ ID NO: 1271 - RNA, 19 nt, Homo sapiens
gaaagcuagcgcccauuca

SEQ ID NO: 1272 - RNA, 19 nt, Homo sapiens
agaaacuacgauugaugga

SEQ ID NO: 1273 - RNA, 19 nt, Homo sapiens
uguuccuuaucgagaaucu

SEQ ID NO: 1274 - RNA, 19 nt, Homo sapiens
cagauuaccucugcgagcc

SEQ ID NO: 1275 - RNA, 19 nt, Homo sapiens
gcgcccauucaauaguaga

SEQ ID NO: 1276 - RNA, 19 nt, Homo sapiens
uugcacuaucuuugcguau

SEQ ID NO: 1277 - RNA, 19 nt, Homo sapiens
cagagcggaaagcuagcgc

SEQ ID NO: 1278 - RNA, 19 nt, Homo sapiens
agaccuuauuugguaaucu

SEQ ID NO: 1279 - RNA, 19 nt, Homo sapiens
auucucuuggagggcguac

SEQ ID NO: 1280 - RNA, 19 nt, Homo sapiens
ggcugguauaauuccacgu

SEQ ID NO: 1281 - RNA, 19 nt, Homo sapiens
gcggaaagcuagcgcccau

SEQ ID NO: 1282 - RNA, 19 nt, Homo sapiens
ugcacuaucuuugcguaug

SEQ ID NO: 1283 - RNA, 19 nt, Homo sapiens
guauaauuccacguacccu

SEQ ID NO: 1284 - RNA, 19 nt, Homo sapiens
agaaucuaaacuaacuaga

SEQ ID NO: 1285 - RNA, 19 nt, Homo sapiens
aggagcugaauaggguuac

SEQ ID NO: 1286 - RNA, 19 nt, Homo sapiens
gaaguacauaagaccuuau

SEQ ID NO: 1287 - RNA, 19 nt, Homo sapiens
gacaguggccgauaagaua

SEQ ID NO: 1288 - RNA, 19 nt, Homo sapiens
aaaccacuuaguagugucc

SEQ ID NO: 1289 - RNA, 19 nt, Homo sapiens
ucccuagacuucccuauuu

SEQ ID NO: 1290 - RNA, 19 nt, Homo sapiens
uagacuucccuauuucgcu

SEQ ID NO: 1291 - RNA, 19 nt, Homo sapiens
gcgucgcagccaaauucgu

SEQ ID NO: 1292 - RNA, 19 nt, Homo sapiens
agcuagcgcccauucaaua

SEQ ID NO: 1293 - RNA, 19 nt, Homo sapiens
gaaacuacgauugauggag

SEQ ID NO: 1294 - RNA, 19 nt, Homo sapiens
ccgauaagauagaagauca

SEQ ID NO: 1295 - RNA, 19 nt, Homo sapiens
uagcgcccauucaauagua

SEQ ID NO: 1296 - RNA, 19 nt, Homo sapiens
uuugcguauggccaaacug

SEQ ID NO: 1297 - RNA, 19 nt, Homo sapiens
cacguacccuucaucaaau

SEQ ID NO: 1298 - RNA, 19 nt, Homo sapiens
ucuuugcguauggccaaac

SEQ ID NO: 1299 - RNA, 19 nt, Homo sapiens
ccgaaguguuguuugucca

SEQ ID NO: 1300 - RNA, 19 nt, Homo sapiens
agagcggaaagcuagcgcc

SEQ ID NO: 1301 - RNA, 19 nt, Homo sapiens
gcuagcgcccauucaauag

SEQ ID NO: 1302 - RNA, 19 nt, Homo sapiens
aaguuaguguacgaacugg

SEQ ID NO: 1303 - RNA, 19 nt, Homo sapiens
guacgaacuggaggauugg

SEQ ID NO: 1304 - RNA, 19 nt, Homo sapiens
acgaacuggaggauuggcu

SEQ ID NO: 1305 - RNA, 19 nt, Homo sapiens
agauugauguuuaccgaag

SEQ ID NO: 1306 - RNA, 19 nt, Homo sapiens
uaugggcuauaauugcacu

SEQ ID NO: 1307 - RNA, 19 nt, Homo sapiens
aucuuugcguauggccaaa

SEQ ID NO: 1308 - RNA, 19 nt, Homo sapiens
acucuagucguucccacuc

SEQ ID NO: 1309 - RNA, 19 nt, Homo sapiens
aacuacgauugauggagaa

SEQ ID NO: 1310 - RNA, 19 nt, Homo sapiens
gauaagagagcucgggaag

SEQ ID NO: 1311 - RNA, 19 nt, Homo sapiens
ucgagaaucuaaacuaacu

SEQ ID NO: 1312 - RNA, 19 nt, Homo sapiens
aacuaacuagaauccucca

SEQ ID NO: 1313 - RNA, 19 nt, Homo sapiens
ggaucguaagaaggcaguu

SEQ ID NO: 1314 - RNA, 19 nt, Homo sapiens
aucguaagaaggcaguuga

SEQ ID NO: 1315 - RNA, 19 nt, Homo sapiens
aggcaguugaccaacacaa

SEQ ID NO: 1316 - RNA, 19 nt, Homo sapiens
uggccgauaagauagaaga

SEQ ID NO: 1317 - RNA, 19 nt, Homo sapiens
ucuaaggauauagucaaca

SEQ ID NO: 1318 - RNA, 19 nt, Homo sapiens
acuaagcuuaauugcuuuc

SEQ ID NO: 1319 - RNA, 19 nt, Homo sapiens
gcccagaucaaccuuuaau

SEQ ID NO: 1320 - RNA, 19 nt, Homo sapiens
uuaauuuggcagagcggaa

SEQ ID NO: 1321 - RNA, 19 nt, Homo sapiens
uuaucgagaaucuaaacua

SEQ ID NO: 1322 - RNA, 19 nt, Homo sapiens
cuagcgcccauucaauagu

SEQ ID NO: 1323 - RNA, 19 nt, Homo sapiens
aauaguagaaugugauccu

SEQ ID NO: 1324 - RNA, 19 nt, Homo sapiens
uacgaaaagaaguuagugu

SEQ ID NO: 1325 - RNA, 19 nt, Homo sapiens
agaaguuaguguacgaacu

SEQ ID NO: 1326 - RNA, 19 nt, Homo sapiens
acuaaacagauugauguuu

SEQ ID NO: 1327 - RNA, 19 nt, Homo sapiens
cuuugcguauggccaaacu

SEQ ID NO: 1328 - RNA, 19 nt, Homo sapiens
aaugaagaguauaccuggg

SEQ ID NO: 1329 - RNA, 19 nt, Homo sapiens
auaauuccacguacccuuc

SEQ ID NO: 1330 - RNA, 19 nt, Homo sapiens
acguacccuucaucaaauu

SEQ ID NO: 1331 - RNA, 19 nt, Homo sapiens
cguacccuucaucaaauuu

SEQ ID NO: 1332 - RNA, 19 nt, Homo sapiens
guacccuucaucaaauuuu

SEQ ID NO: 1333 - RNA, 19 nt, Homo sapiens
aacuuacugauaaugguac

SEQ ID NO: 1334 - RNA, 19 nt, Homo sapiens
uucagucaaagugucucug

SEQ ID NO: 1335 - RNA, 19 nt, Homo sapiens
uucuuaauccaucaucuga

SEQ ID NO: 1336 - RNA, 19 nt, Homo sapiens
acaguacacaacaaggaug

SEQ ID NO: 1337 - RNA, 19 nt, Homo sapiens
aagaaacuacgauugaugg

SEQ ID NO: 1338 - RNA, 19 nt, Homo sapiens
aaacuacgauugauggaga

SEQ ID NO: 1339 - RNA, 19 nt, Homo sapiens
uggagcuguugauaagaga

SEQ ID NO: 1340 - RNA, 19 nt, Homo sapiens
cuaacuagaauccuccagg

SEQ ID NO: 1341 - RNA, 19 nt, Homo sapiens
gaauaugcucauagagcaa

SEQ ID NO: 1342 - RNA, 19 nt, Homo sapiens
augcucauagagcaaagaa

SEQ ID NO: 1343 - RNA, 19 nt, Homo sapiens
aaaaauuggugcuguugag

SEQ ID NO: 1344 - RNA, 19 nt, Homo sapiens
gaggagcugaauaggguua

SEQ ID NO: 1345 - RNA, 19 nt, Homo sapiens
ggagcugaauaggguuaca

SEQ ID NO: 1346 - RNA, 19 nt, Homo sapiens
gagcugaauaggguuacag

SEQ ID NO: 1347 - RNA, 19 nt, Homo sapiens
agcugaauaggguuacaga

SEQ ID NO: 1348 - RNA, 19 nt, Homo sapiens
gcugaauaggguuacagag

SEQ ID NO: 1349 - RNA, 19 nt, Homo sapiens
ccaaacuggaucguaagaa

SEQ ID NO: 1350 - RNA, 19 nt, Homo sapiens
gaucguaagaaggcaguug

SEQ ID NO: 1351 - RNA, 19 nt, Homo sapiens
accuuauuugguaaucugc

SEQ ID NO: 1352 - RNA, 19 nt, Homo sapiens
uuagauaccauuacuacag

SEQ ID NO: 1353 - RNA, 19 nt, Homo sapiens
auaccauuacuacaguagc

SEQ ID NO: 1354 - RNA, 19 nt, Homo sapiens
uacuacaguagcacuugga

SEQ ID NO: 1355 - RNA, 19 nt, Homo sapiens
aaaguaaaacuguacuaca

SEQ ID NO: 1356 - RNA, 19 nt, Homo sapiens
cucaagacugaucuucuaa

SEQ ID NO: 1357 - RNA, 19 nt, Homo sapiens
uugacaguggccgauaaga

SEQ ID NO: 1358 - RNA, 19 nt, Homo sapiens
ugacaguggccgauaagau

SEQ ID NO: 1359 - RNA, 19 nt, Homo sapiens
gcaauguggaaaccuaacu

SEQ ID NO: 1360 - RNA, 19 nt, Homo sapiens
ccacuuaguaguguccagg

SEQ ID NO: 1361 - RNA, 19 nt, Homo sapiens
agaagguacaaaauugguu

SEQ ID NO: 1362 - RNA, 19 nt, Homo sapiens
ugguuugacuaagcuuaau

SEQ ID NO: 1363 - RNA, 19 nt, Homo sapiens
gguuugacuaagcuuaauu

SEQ ID NO: 1364 - RNA, 19 nt, Homo sapiens
ucuaagucaagagccaucu

SEQ ID NO: 1365 - RNA, 19 nt, Homo sapiens
ucaucccuauaguucacuu

SEQ ID NO: 1366 - RNA, 19 nt, Homo sapiens
caucccuauaguucacuuu

SEQ ID NO: 1367 - RNA, 19 nt, Homo sapiens
cccuagacuucccuauuuc

SEQ ID NO: 1368 - RNA, 19 nt, Homo sapiens
agacuucccuauuucgcuu

SEQ ID NO: 1369 - RNA, 19 nt, Homo sapiens
ucaccaaaccauuuguaga

SEQ ID NO: 1370 - RNA, 19 nt, Homo sapiens
uccuuuaagaggccuaacu

SEQ ID NO: 1371 - RNA, 19 nt, Homo sapiens
uuuaagaggccuaacucau

SEQ ID NO: 1372 - RNA, 19 nt, Homo sapiens
uuaagaggccuaacucauu

SEQ ID NO: 1373 - RNA, 19 nt, Homo sapiens
ggccuaacucauucacccu

SEQ ID NO: 1374 - RNA, 19 nt, Homo sapiens
ugguauuuuugaucuggca

SEQ ID NO: 1375 - RNA, 19 nt, Homo sapiens
aguuuaguguguaaaguuu

SEQ ID NO: 1376 - RNA, 19 nt, Homo sapiens
gccaaauucgucugcgaag

SEQ ID NO: 1377 - RNA, 19 nt, Homo sapiens
aauucgucugcgaagaaga

SEQ ID NO: 1378 - RNA, 19 nt, Homo sapiens
ugaaaggucaccuaaugaa

SEQ ID NO: 1379 - RNA, 19 nt, Homo sapiens
cagaccauuuaauuuggca

SEQ ID NO: 1380 - RNA, 19 nt, Homo sapiens
agaccauuuaauuuggcag

SEQ ID NO: 1381 - RNA, 19 nt, Homo sapiens
aguuauuaugggcuauaau

SEQ ID NO: 1382 - RNA, 19 nt, Homo sapiens
gcugguauaauuccacgua

SEQ ID NO: 1383 - RNA, 19 nt, Homo sapiens
auuuaauuuggcagagcgg

SEQ ID NO: 1384 - RNA, 19 nt, Homo sapiens
uuuaauuuggcagagcgga

SEQ ID NO: 1385 - RNA, 19 nt, Homo sapiens
uuuggcagagcggaaagcu

SEQ ID NO: 1386 - RNA, 19 nt, Homo sapiens
uuuuacaauggaaggugaa

SEQ ID NO: 1387 - RNA, 19 nt, Homo sapiens
aauggaaggugaaagguca

SEQ ID NO: 1388 - RNA, 19 nt, Homo sapiens
ugagaugcagaccauuuaa

SEQ ID NO: 1389 - RNA, 19 nt, Homo sapiens
ucgcagccaaauucgucug

SEQ ID NO: 1390 - RNA, 19 nt, Homo sapiens
ggcuauaauugcacuaucu

SEQ ID NO: 1391 - RNA, 19 nt, Homo sapiens
auugacaguggccgauaag

SEQ ID NO: 1392 - RNA, 19 nt, Homo sapiens
cuagacuucccuauuucgc

SEQ ID NO: 1393 - RNA, 19 nt, Homo sapiens
acuaucuuugcguauggcc

SEQ ID NO: 1394 - RNA, 19 nt, Homo sapiens
auacucuagucguucccac

SEQ ID NO: 1395 - RNA, 19 nt, Homo sapiens
aaagaaacuacgauugaug

SEQ ID NO: 1396 - RNA, 19 nt, Homo sapiens
gccuugauuuuuuggcggg

SEQ ID NO: 1397 - RNA, 19 nt, Homo sapiens
cgcccauucaauaguagaa

SEQ ID NO: 1398 - RNA, 19 nt, Homo sapiens
ccuuauuugguaaucugcu

SEQ ID NO: 1399 - RNA, 19 nt, Homo sapiens
agagacaauuccggaugug

SEQ ID NO: 1400 - RNA, 19 nt, Homo sapiens
ugacuuugauagcuaaauu

SEQ ID NO: 1401 - RNA, 19 nt, Homo sapiens
uggcagagcggaaagcuag

SEQ ID NO: 1402 - RNA, 19 nt, Homo sapiens
gagcggaaagcuagcgccc

SEQ ID NO: 1403 - RNA, 19 nt, Homo sapiens
aaagaaguuaguguacgaa

SEQ ID NO: 1404 - RNA, 19 nt, Homo sapiens
auugcacuaucuuugcgua

SEQ ID NO: 1405 - RNA, 19 nt, Homo sapiens
gguauaauuccacguaccc

SEQ ID NO: 1406 - RNA, 19 nt, Homo sapiens
uacucuagucguucccacu

SEQ ID NO: 1407 - RNA, 19 nt, Homo sapiens
uaugaaagaaacuacgauu

SEQ ID NO: 1408 - RNA, 19 nt, Homo sapiens
augcuagaaguacauaaga

SEQ ID NO: 1409 - RNA, 19 nt, Homo sapiens
aaguacauaagaccuuauu

SEQ ID NO: 1410 - RNA, 19 nt, Homo sapiens
acagccugagcuguuaaug

SEQ ID NO: 1411 - RNA, 19 nt, Homo sapiens
aaagaagagacaauuccgg

SEQ ID NO: 1412 - RNA, 19 nt, Homo sapiens
cacacuggagaggucuaaa

SEQ ID NO: 1413 - RNA, 19 nt, Homo sapiens
cacuggagaggucuaaagu

SEQ ID NO: 1414 - RNA, 19 nt, Homo sapiens
acuggagaggucuaaagug

SEQ ID NO: 1415 - RNA, 19 nt, Homo sapiens
cgucgcagccaaauucguc

SEQ ID NO: 1416 - RNA, 19 nt, Homo sapiens
gaaggcaguugaccaacac

SEQ ID NO: 1417 - RNA, 19 nt, Homo sapiens
cauucacccugacagaguu

SEQ ID NO: 1418 - RNA, 19 nt, Homo sapiens
aagaggccuaacucauuca

SEQ ID NO: 1419 - RNA, 19 nt, Homo sapiens
gagacaauuccggaugugg

SEQ ID NO: 1420 - RNA, 19 nt, Homo sapiens
uuccggauguggauguaga

SEQ ID NO: 1421 - RNA, 19 nt, Homo sapiens
aagcuagcgcccauucaau

SEQ ID NO: 1422 - RNA, 19 nt, Homo sapiens
gaaguuaguguacgaacug

SEQ ID NO: 1423 - RNA, 19 nt, Homo sapiens
uauaauuccacguacccuu

SEQ ID NO: 1424 - RNA, 19 nt, Homo sapiens
acaguggccgauaagauag

SEQ ID NO: 1425 - RNA, 19 nt, Homo sapiens
ucugucaucccuauaguuc

SEQ ID NO: 1426 - RNA, 19 nt, Homo sapiens
uucuugcuaugacuugugu

SEQ ID NO: 1427 - RNA, 19 nt, Homo sapiens
guaagaaggcaguugacca

SEQ ID NO: 1428 - RNA, 19 nt, Homo sapiens
cauugacaguggccgauaa

SEQ ID NO: 1429 - RNA, 19 nt, Homo sapiens
agaaaccacuuaguagugu

SEQ ID NO: 1430 - RNA, 19 nt, Homo sapiens
ggauuguucaucaauuggc

SEQ ID NO: 1431 - RNA, 19 nt, Homo sapiens
uaagaggccuaacucauuc

SEQ ID NO: 1432 - RNA, 19 nt, Homo sapiens
aguuaguguacgaacugga

SEQ ID NO: 1433 - RNA, 19 nt, Homo sapiens
aguacauaagaccuuauuu

SEQ ID NO: 1434 - RNA, 19 nt, Homo sapiens
ugagccuuguguauagauu

SEQ ID NO: 1435 - RNA, 19 nt, Homo sapiens
ccuuuaagaggccuaacuc

SEQ ID NO: 1436 - RNA, 19 nt, Homo sapiens
accacuuaguaguguccag

SEQ ID NO: 1437 - RNA, 19 nt, Homo sapiens
gaaacuuccaauuaugucu

SEQ ID NO: 1438 - RNA, 19 nt, Homo sapiens
ugcauacucuagucguucc

SEQ ID NO: 1439 - RNA, 19 nt, Homo sapiens
agaaggcaguugaccaaca

SEQ ID NO: 1440 - RNA, 19 nt, Homo sapiens
guacauaagaccuuauuug

SEQ ID NO: 1441 - RNA, 19 nt, Homo sapiens
uauaauugcacuaucuuug

SEQ ID NO: 1442 - RNA, 19 nt, Homo sapiens
ucucuguuacaauacauau

SEQ ID NO: 1443 - RNA, 19 nt, Homo sapiens
uaugcucauagagcaaaga

SEQ ID NO: 1444 - RNA, 19 nt, Homo sapiens
uguuguuuguccaauucug

SEQ ID NO: 1445 - RNA, 19 nt, Homo sapiens
acuaacuagaauccuccag

SEQ ID NO: 1446 - RNA, 19 nt, Homo sapiens
uguggugucuauacugaaa

SEQ ID NO: 1447 - RNA, 19 nt, Homo sapiens
uauuaugggagaccaccca

SEQ ID NO: 1448 - RNA, 19 nt, Homo sapiens
aaggaugaagucuaucaaa

SEQ ID NO: 1449 - RNA, 19 nt, Homo sapiens
uugauaagagagcucggga

SEQ ID NO: 1450 - RNA, 19 nt, Homo sapiens
auguuccuuaucgagaauc

SEQ ID NO: 1451 - RNA, 19 nt, Homo sapiens
ggaauaugcucauagagca

SEQ ID NO: 1452 - RNA, 19 nt, Homo sapiens
ccauuccaaacuggaucgu

SEQ ID NO: 1453 - RNA, 19 nt, Homo sapiens
ggcaguugaccaacacaau

SEQ ID NO: 1454 - RNA, 19 nt, Homo sapiens
caugcuagaaguacauaag

SEQ ID NO: 1455 - RNA, 19 nt, Homo sapiens
cuagaaguacauaagaccu

SEQ ID NO: 1456 - RNA, 19 nt, Homo sapiens
uuggaucucucacaucuau

SEQ ID NO: 1457 - RNA, 19 nt, Homo sapiens
aacuguggugucuauacug

SEQ ID NO: 1458 - RNA, 19 nt, Homo sapiens
ucauugacaguggccgaua

SEQ ID NO: 1459 - RNA, 19 nt, Homo sapiens
auaaagcagacccauuccc

SEQ ID NO: 1460 - RNA, 19 nt, Homo sapiens
acagaaaccacuuaguagu

SEQ ID NO: 1461 - RNA, 19 nt, Homo sapiens
gaaaccacuuaguaguguc

SEQ ID NO: 1462 - RNA, 19 nt, Homo sapiens
aaaucuaaggauauaguca

SEQ ID NO: 1463 - RNA, 19 nt, Homo sapiens
uuauuuauacccaucaaca

SEQ ID NO: 1464 - RNA, 19 nt, Homo sapiens
acagaggcauuaacacacu

SEQ ID NO: 1465 - RNA, 19 nt, Homo sapiens
acacacuggagaggucuaa

SEQ ID NO: 1466 - RNA, 19 nt, Homo sapiens
acacuggagaggucuaaag

SEQ ID NO: 1467 - RNA, 19 nt, Homo sapiens
cgagcccagaucaaccuuu

SEQ ID NO: 1468 - RNA, 19 nt, Homo sapiens
ucccuauuucgcuuucucc

SEQ ID NO: 1469 - RNA, 19 nt, Homo sapiens
ucuaaaaucacugucaaca

SEQ ID NO: 1470 - RNA, 19 nt, Homo sapiens
agccaaauucgucugcgaa

SEQ ID NO: 1471 - RNA, 19 nt, Homo sapiens
cccauucaauaguagaaug

SEQ ID NO: 1472 - RNA, 19 nt, Homo sapiens
gaugaaugcauacucuagu

SEQ ID NO: 1473 - RNA, 19 nt, Homo sapiens
cucauguuccuuaucgaga

SEQ ID NO: 1474 - RNA, 19 nt, Homo sapiens
gagaaucuaaacuaacuag

SEQ ID NO: 1475 - RNA, 19 nt, Homo sapiens
uagaaguacauaagaccuu

SEQ ID NO: 1476 - RNA, 19 nt, Homo sapiens
cagccugagcuguuaauga

SEQ ID NO: 1477 - RNA, 19 nt, Homo sapiens
aagaagagacaauuccgga

SEQ ID NO: 1478 - RNA, 19 nt, Homo sapiens
ugcugguguggauuguuca

SEQ ID NO: 1479 - RNA, 19 nt, Homo sapiens
aaauucgucugcgaagaag

SEQ ID NO: 1480 - RNA, 19 nt, Homo sapiens
uuucuggaaguugagaugu

SEQ ID NO: 1481 - RNA, 19 nt, Homo sapiens
uacuaaacagauugauguu

SEQ ID NO: 1482 - RNA, 19 nt, Homo sapiens
gauugauguuuaccgaagu

SEQ ID NO: 1483 - RNA, 19 nt, Homo sapiens
gcacuaucuuugcguaugg

SEQ ID NO: 1484 - RNA, 19 nt, Homo sapiens
ugguauaauuccacguacc

SEQ ID NO: 1485 - RNA, 19 nt, Homo sapiens
agcaagcugcuuaacacag

SEQ ID NO: 1486 - RNA, 19 nt, Homo sapiens
cagaaaccacuuaguagug

SEQ ID NO: 1487 - RNA, 19 nt, Homo sapiens
aacuuauuggagguuguaa

SEQ ID NO: 1488 - RNA, 19 nt, Homo sapiens
cuggagaggucuaaagugg

SEQ ID NO: 1489 - RNA, 19 nt, Homo sapiens
aaaaaagauauaaggcagu

SEQ ID NO: 1490 - RNA, 19 nt, Homo sapiens
gaauuuugauaucuaccca

SEQ ID NO: 1491 - RNA, 19 nt, Homo sapiens
guauuuuugaucuggcaac

SEQ ID NO: 1492 - RNA, 19 nt, Homo sapiens
aggaucccuuggcugguau

SEQ ID NO: 1493 - RNA, 19 nt, Homo sapiens
ggaucccuuggcugguaua

SEQ ID NO: 1494 - RNA, 19 nt, Homo sapiens
caauaguagaaugugaucc

SEQ ID NO: 1495 - RNA, 19 nt, Homo sapiens
gcuauaauugcacuaucuu

SEQ ID NO: 1496 - RNA, 19 nt, Homo sapiens
uacccuucaucaaauuuuu

SEQ ID NO: 1497 - RNA, 19 nt, Homo sapiens
agaacauauugaauaagcc

SEQ ID NO: 1498 - RNA, 19 nt, Homo sapiens
aaauuggugcuguugagga

SEQ ID NO: 1499 - RNA, 19 nt, Homo sapiens
ugaauaggguuacagaguu

SEQ ID NO: 1500 - RNA, 19 nt, Homo sapiens
aagaacuugaaaccacuca

SEQ ID NO: 1501 - RNA, 19 nt, Homo sapiens
aauaaagcagacccauucc

SEQ ID NO: 1502 - RNA, 19 nt, Homo sapiens
auacccaucaacacuggua

SEQ ID NO: 1503 - RNA, 19 nt, Homo sapiens
uggauuguucaucaauugg

SEQ ID NO: 1504 - RNA, 19 nt, Homo sapiens
uggagaggucuaaagugga

SEQ ID NO: 1505 - RNA, 19 nt, Homo sapiens
gucaucccuauaguucacu

SEQ ID NO: 1506 - RNA, 19 nt, Homo sapiens
auaauggcuauaauuucuc

SEQ ID NO: 1507 - RNA, 19 nt, Homo sapiens
aucccuuggcugguauaau

SEQ ID NO: 1508 - RNA, 19 nt, Homo sapiens
gggcuauaauugcacuauc

SEQ ID NO: 1509 - RNA, 19 nt, Homo sapiens
gauucucuuggagggcgua

SEQ ID NO: 1510 - RNA, 19 nt, Homo sapiens
gcaucucucaaucuugagg

SEQ ID NO: 1511 - RNA, 19 nt, Homo sapiens
cagcagaaaucuaaggaua

SEQ ID NO: 1512 - RNA, 19 nt, Homo sapiens
gucaagagccaucuguaga

SEQ ID NO: 1513 - RNA, 19 nt, Homo sapiens
aaacagaggcauuaacaca

SEQ ID NO: 1514 - RNA, 19 nt, Homo sapiens
agcccagaucaaccuuuaa

SEQ ID NO: 1515 - RNA, 19 nt, Homo sapiens
uauuuuugaucuggcaacc

SEQ ID NO: 1516 - RNA, 19 nt, Homo sapiens
uguuuggagcaucuacuaa

SEQ ID NO: 1517 - RNA, 19 nt, Homo sapiens
gaaauuacaguacacaaca

SEQ ID NO: 1518 - RNA, 19 nt, Homo sapiens
acuugaccaguguaaaucu

SEQ ID NO: 1519 - RNA, 19 nt, Homo sapiens
accaguguaaaucugaccu

SEQ ID NO: 1520 - RNA, 19 nt, Homo sapiens
agaacaaucauuagcagca

SEQ ID NO: 1521 - RNA, 19 nt, Homo sapiens
caauguggaaaccuaacug

SEQ ID NO: 1522 - RNA, 19 nt, Homo sapiens
accaagaagguacaaaauu

SEQ ID NO: 1523 - RNA, 19 nt, Homo sapiens
gguacaaaauugguugaag

SEQ ID NO: 1524 - RNA, 19 nt, Homo sapiens
gguguggauuguucaucaa

SEQ ID NO: 1525 - RNA, 19 nt, Homo sapiens
agaguucacaaaaagccca

SEQ ID NO: 1526 - RNA, 19 nt, Homo sapiens
ugauagcuaaauuaaacca

SEQ ID NO: 1527 - RNA, 19 nt, Homo sapiens
aauaagccugaagugaauc

SEQ ID NO: 1528 - RNA, 19 nt, Homo sapiens
caguugaccaacacaaugc

SEQ ID NO: 1529 - RNA, 19 nt, Homo sapiens
ugguguggauuguucauca

SEQ ID NO: 1530 - RNA, 19 nt, Homo sapiens
auucacccugacagaguuc

SEQ ID NO: 1531 - RNA, 19 nt, Homo sapiens
uaagaccuuauuugguaau

SEQ ID NO: 1532 - RNA, 19 nt, Homo sapiens
aagcaauguggaaaccuaa

SEQ ID NO: 1533 - RNA, 19 nt, Homo sapiens
ucugaaacuggauauccca

SEQ ID NO: 1534 - DNA, 21 bp, Artificial Sequence
  Description of Combined DNA/RNA Molecule: Synthetic oligonucleotide
  Description of Artificial Sequence: Synthetic oligonucleotide
ucgagaaucuaaacuaacutt

SEQ ID NO: 1535 - DNA, 21 bp, Artificial Sequence
  Description of Combined DNA/RNA Molecule: Synthetic oligonucleotide
  Description of Artificial Sequence: Synthetic oligonucleotide
aguccuuagauuugauugatt

SEQ ID NO: 1536 - RNA, 21 nt, Artificial Sequence
  Description of Artificial Sequence: Synthetic oligonucleotide
gcacauaggagagaugagcuu

SEQ ID NO: 1537 - RNA, 23 nt, Artificial Sequence
  Description of Artificial Sequence: Synthetic oligonucleotide
gucguguauccucucuacucgaa

SEQ ID NO: 1538 - RNA, 23 nt, Homo sapiens
aagcucaucucuccuaugugcug

SEQ ID NO: 1539 - RNA, 444 nt, Homo sapiens
augaacuuucugcugucuugggugcauuggagccuugccuugcugcucuaccuccaccaugccaaguggucccaggcugcacccauggcagaaggaggagggcagaaucaucacgaaguggugaaguucauggaugucuaucagcgcagcuacugccauccaaucgagacccugguggacaucuuccaggaguacccugaugagaucgaguacaucuucaagccauccugugugccccugaugcgaugcgggggcugcugcaaugacgagggccuggagugugugcccacugaggaguccaacaucaccaugcagauuaugcggaucaaaccucaccaaggccagcacauaggagagaugagcuuccuacagcacaacaaaugugaaugcagaccaaagaaagauagagcaagacaagaaaaaugugacaagccgaggcgguga

SEQ ID NO: 1540 - RNA, 23 nt, Homo sapiens
augaacuuucugcugucuugggu

SEQ ID NO: 1541 - RNA, 23 nt, Homo sapiens
ugaacuuucugcugucuugggug

SEQ ID NO: 1542 - RNA, 23 nt, Homo sapiens
gaacuuucugcugucuugggugc

SEQ ID NO: 1543 - RNA, 23 nt, Homo sapiens
aacuuucugcugucuugggugca

SEQ ID NO: 1544 - RNA, 23 nt, Homo sapiens
acuuucugcugucuugggugcau

SEQ ID NO: 1545 - RNA, 23 nt, Homo sapiens
cuuucugcugucuugggugcauu

SEQ ID NO: 1546 - RNA, 23 nt, Homo sapiens
uuucugcugucuugggugcauug

SEQ ID NO: 1547 - RNA, 23 nt, Homo sapiens
uucugcugucuugggugcauugg

SEQ ID NO: 1548 - RNA, 23 nt, Homo sapiens
ucugcugucuugggugcauugga

SEQ ID NO: 1549 - RNA, 23 nt, Homo sapiens
cugcugucuugggugcauuggag

SEQ ID NO: 1550 - RNA, 23 nt, Homo sapiens
ugcugucuugggugcauuggagc

SEQ ID NO: 1551 - RNA, 23 nt, Homo sapiens
gcugucuugggugcauuggagcc

SEQ ID NO: 1552 - RNA, 23 nt, Homo sapiens
cugucuugggugcauuggagccu

SEQ ID NO: 1553 - RNA, 23 nt, Homo sapiens
ugucuugggugcauuggagccuu

SEQ ID NO: 1554 - RNA, 23 nt, Homo sapiens
gucuugggugcauuggagccuug

SEQ ID NO: 1555 - RNA, 23 nt, Homo sapiens
ucuugggugcauuggagccuugc

SEQ ID NO: 1556 - RNA, 23 nt, Homo sapiens
cuugggugcauuggagccuugcc

SEQ ID NO: 1557 - RNA, 23 nt, Homo sapiens
uugggugcauuggagccuugccu

SEQ ID NO: 1558 - RNA, 23 nt, Homo sapiens
ugggugcauuggagccuugccuu

SEQ ID NO: 1559 - RNA, 23 nt, Homo sapiens
gggugcauuggagccuugccuug

SEQ ID NO: 1560 - RNA, 23 nt, Homo sapiens
ggugcauuggagccuugccuugc

SEQ ID NO: 1561 - RNA, 23 nt, Homo sapiens
gugcauuggagccuugccuugcu

SEQ ID NO: 1562 - RNA, 23 nt, Homo sapiens
ugcauuggagccuugccuugcug

SEQ ID NO: 1563 - RNA, 23 nt, Homo sapiens
gcauuggagccuugccuugcugc

SEQ ID NO: 1564 - RNA, 23 nt, Homo sapiens
cauuggagccuugccuugcugcu

SEQ ID NO: 1565 - RNA, 23 nt, Homo sapiens
auuggagccuugccuugcugcuc

SEQ ID NO: 1566 - RNA, 23 nt, Homo sapiens
uuggagccuugccuugcugcucu

SEQ ID NO: 1567 - RNA, 23 nt, Homo sapiens
uggagccuugccuugcugcucua

SEQ ID NO: 1568 - RNA, 23 nt, Homo sapiens
ggagccuugccuugcugcucuac

SEQ ID NO: 1569 - RNA, 23 nt, Homo sapiens
gagccuugccuugcugcucuacc

SEQ ID NO: 1570 - RNA, 23 nt, Homo sapiens
agccuugccuugcugcucuaccu

SEQ ID NO: 1571 - RNA, 23 nt, Homo sapiens
gccuugccuugcugcucuaccuc

SEQ ID NO: 1572 - RNA, 23 nt, Homo sapiens
ccuugccuugcugcucuaccucc

SEQ ID NO: 1573 - RNA, 23 nt, Homo sapiens
cuugccuugcugcucuaccucca

SEQ ID NO: 1574 - RNA, 23 nt, Homo sapiens
uugccuugcugcucuaccuccac

SEQ ID NO: 1575 - RNA, 23 nt, Homo sapiens
ugccuugcugcucuaccuccacc

SEQ ID NO: 1576 - RNA, 23 nt, Homo sapiens
gccuugcugcucuaccuccacca

SEQ ID NO: 1577 - RNA, 23 nt, Homo sapiens
ccuugcugcucuaccuccaccau

SEQ ID NO: 1578 - RNA, 23 nt, Homo sapiens
cuugcugcucuaccuccaccaug

SEQ ID NO: 1579 - RNA, 23 nt, Homo sapiens
uugcugcucuaccuccaccaugc

SEQ ID NO: 1580 - RNA, 23 nt, Homo sapiens
ugcugcucuaccuccaccaugcc

SEQ ID NO: 1581 - RNA, 23 nt, Homo sapiens
gcugcucuaccuccaccaugcca

SEQ ID NO: 1582 - RNA, 23 nt, Homo sapiens
cugcucuaccuccaccaugccaa

SEQ ID NO: 1583 - RNA, 23 nt, Homo sapiens
ugcucuaccuccaccaugccaag

SEQ ID NO: 1584 - RNA, 23 nt, Homo sapiens
gcucuaccuccaccaugccaagu

SEQ ID NO: 1585 - RNA, 23 nt, Homo sapiens
cucuaccuccaccaugccaagug

SEQ ID NO: 1586 - RNA, 23 nt, Homo sapiens
ucuaccuccaccaugccaagugg

SEQ ID NO: 1587 - RNA, 23 nt, Homo sapiens
cuaccuccaccaugccaaguggu

SEQ ID NO: 1588 - RNA, 23 nt, Homo sapiens
uaccuccaccaugccaagugguc

SEQ ID NO: 1589 - RNA, 23 nt, Homo sapiens
accuccaccaugccaaguggucc

SEQ ID NO: 1590 - RNA, 23 nt, Homo sapiens
ccuccaccaugccaagugguccc

SEQ ID NO: 1591 - RNA, 23 nt, Homo sapiens
cuccaccaugccaagugguccca

SEQ ID NO: 1592 - RNA, 23 nt, Homo sapiens
uccaccaugccaaguggucccag

SEQ ID NO: 1593 - RNA, 23 nt, Homo sapiens
ccaccaugccaaguggucccagg

SEQ ID NO: 1594 - RNA, 23 nt, Homo sapiens
caccaugccaaguggucccaggc

SEQ ID NO: 1595 - RNA, 23 nt, Homo sapiens
accaugccaaguggucccaggcu

SEQ ID NO: 1596 - RNA, 23 nt, Homo sapiens
ccaugccaaguggucccaggcug

SEQ ID NO: 1597 - RNA, 23 nt, Homo sapiens
caugccaaguggucccaggcugc

SEQ ID NO: 1598 - RNA, 23 nt, Homo sapiens
augccaaguggucccaggcugca

SEQ ID NO: 1599 - RNA, 23 nt, Homo sapiens
ugccaaguggucccaggcugcac

SEQ ID NO: 1600 - RNA, 23 nt, Homo sapiens
gccaaguggucccaggcugcacc

SEQ ID NO: 1601 - RNA, 23 nt, Homo sapiens
ccaaguggucccaggcugcaccc

SEQ ID NO: 1602 - RNA, 23 nt, Homo sapiens
caaguggucccaggcugcaccca

SEQ ID NO: 1603 - RNA, 23 nt, Homo sapiens
aaguggucccaggcugcacccau

SEQ ID NO: 1604 - RNA, 23 nt, Homo sapiens
aguggucccaggcugcacccaug

SEQ ID NO: 1605 - RNA, 23 nt, Homo sapiens
guggucccaggcugcacccaugg

SEQ ID NO: 1606 - RNA, 23 nt, Homo sapiens
uggucccaggcugcacccauggc

SEQ ID NO: 1607 - RNA, 23 nt, Homo sapiens
ggucccaggcugcacccauggca

SEQ ID NO: 1608 - RNA, 23 nt, Homo sapiens
gucccaggcugcacccauggcag

SEQ ID NO: 1609 - RNA, 23 nt, Homo sapiens
ucccaggcugcacccauggcaga

SEQ ID NO: 1610 - RNA, 23 nt, Homo sapiens
cccaggcugcacccauggcagaa

SEQ ID NO: 1611 - RNA, 23 nt, Homo sapiens
ccaggcugcacccauggcagaag

SEQ ID NO: 1612 - RNA, 23 nt, Homo sapiens
caggcugcacccauggcagaagg

SEQ ID NO: 1613 - RNA, 23 nt, Homo sapiens
aggcugcacccauggcagaagga

SEQ ID NO: 1614 - RNA, 23 nt, Homo sapiens
ggcugcacccauggcagaaggag

SEQ ID NO: 1615 - RNA, 23 nt, Homo sapiens
gcugcacccauggcagaaggagg

SEQ ID NO: 1616 - RNA, 23 nt, Homo sapiens
cugcacccauggcagaaggagga

SEQ ID NO: 1617 - RNA, 23 nt, Homo sapiens
ugcacccauggcagaaggaggag

SEQ ID NO: 1618 - RNA, 23 nt, Homo sapiens
gcacccauggcagaaggaggagg

SEQ ID NO: 1619 - RNA, 23 nt, Homo sapiens
cacccauggcagaaggaggaggg

SEQ ID NO: 1620 - RNA, 23 nt, Homo sapiens
acccauggcagaaggaggagggc

SEQ ID NO: 1621 - RNA, 23 nt, Homo sapiens
cccauggcagaaggaggagggca

SEQ ID NO: 1622 - RNA, 23 nt, Homo sapiens
ccauggcagaaggaggagggcag

SEQ ID NO: 1623 - RNA, 23 nt, Homo sapiens
cauggcagaaggaggagggcaga

SEQ ID NO: 1624 - RNA, 23 nt, Homo sapiens
auggcagaaggaggagggcagaa

SEQ ID NO: 1625 - RNA, 23 nt, Homo sapiens
uggcagaaggaggagggcagaau

SEQ ID NO: 1626 - RNA, 23 nt, Homo sapiens
ggcagaaggaggagggcagaauc

SEQ ID NO: 1627 - RNA, 23 nt, Homo sapiens
gcagaaggaggagggcagaauca

SEQ ID NO: 1628 - RNA, 23 nt, Homo sapiens
cagaaggaggagggcagaaucau

SEQ ID NO: 1629 - RNA, 23 nt, Homo sapiens
agaaggaggagggcagaaucauc

SEQ ID NO: 1630 - RNA, 23 nt, Homo sapiens
gaaggaggagggcagaaucauca

SEQ ID NO: 1631 - RNA, 23 nt, Homo sapiens
aaggaggagggcagaaucaucac

SEQ ID NO: 1632 - RNA, 23 nt, Homo sapiens
aggaggagggcagaaucaucacg

SEQ ID NO: 1633 - RNA, 23 nt, Homo sapiens
ggaggagggcagaaucaucacga

SEQ ID NO: 1634 - RNA, 23 nt, Homo sapiens
gaggagggcagaaucaucacgaa

SEQ ID NO: 1635 - RNA, 23 nt, Homo sapiens
aggagggcagaaucaucacgaag

SEQ ID NO: 1636 - RNA, 23 nt, Homo sapiens
ggagggcagaaucaucacgaagu

SEQ ID NO: 1637 - RNA, 23 nt, Homo sapiens
gagggcagaaucaucacgaagug

SEQ ID NO: 1638 - RNA, 23 nt, Homo sapiens
agggcagaaucaucacgaagugg

SEQ ID NO: 1639 - RNA, 23 nt, Homo sapiens
gggcagaaucaucacgaaguggu

SEQ ID NO: 1640 - RNA, 23 nt, Homo sapiens
ggcagaaucaucacgaaguggug

SEQ ID NO: 1641 - RNA, 23 nt, Homo sapiens
gcagaaucaucacgaagugguga

SEQ ID NO: 1642 - RNA, 23 nt, Homo sapiens
cagaaucaucacgaaguggugaa

SEQ ID NO: 1643 - RNA, 23 nt, Homo sapiens
agaaucaucacgaaguggugaag

SEQ ID NO: 1644 - RNA, 23 nt, Homo sapiens
gaaucaucacgaaguggugaagu

SEQ ID NO: 1645 - RNA, 23 nt, Homo sapiens
aaucaucacgaaguggugaaguu

SEQ ID NO: 1646 - RNA, 23 nt, Homo sapiens
aucaucacgaaguggugaaguuc

SEQ ID NO: 1647 - RNA, 23 nt, Homo sapiens
ucaucacgaaguggugaaguuca

SEQ ID NO: 1648 - RNA, 23 nt, Homo sapiens
caucacgaaguggugaaguucau

SEQ ID NO: 1649 - RNA, 23 nt, Homo sapiens
aucacgaaguggugaaguucaug

SEQ ID NO: 1650 - RNA, 23 nt, Homo sapiens
ucacgaaguggugaaguucaugg

SEQ ID NO: 1651 - RNA, 23 nt, Homo sapiens
cacgaaguggugaaguucaugga

SEQ ID NO: 1652 - RNA, 23 nt, Homo sapiens
acgaaguggugaaguucauggau

SEQ ID NO: 1653 - RNA, 23 nt, Homo sapiens
cgaaguggugaaguucauggaug

SEQ ID NO: 1654 - RNA, 23 nt, Homo sapiens
gaaguggugaaguucauggaugu

SEQ ID NO: 1655 - RNA, 23 nt, Homo sapiens
aaguggugaaguucauggauguc

SEQ ID NO: 1656 - RNA, 23 nt, Homo sapiens
aguggugaaguucauggaugucu

SEQ ID NO: 1657 - RNA, 23 nt, Homo sapiens
guggugaaguucauggaugucua

SEQ ID NO: 1658 - RNA, 23 nt, Homo sapiens
uggugaaguucauggaugucuau

SEQ ID NO: 1659 - RNA, 23 nt, Homo sapiens
ggugaaguucauggaugucuauc

SEQ ID NO: 1660 - RNA, 23 nt, Homo sapiens
gugaaguucauggaugucuauca

SEQ ID NO: 1661 - RNA, 23 nt, Homo sapiens
ugaaguucauggaugucuaucag

SEQ ID NO: 1662 - RNA, 23 nt, Homo sapiens
gaaguucauggaugucuaucagc

SEQ ID NO: 1663 - RNA, 23 nt, Homo sapiens
aaguucauggaugucuaucagcg

SEQ ID NO: 1664 - RNA, 23 nt, Homo sapiens
aguucauggaugucuaucagcgc

SEQ ID NO: 1665 - RNA, 23 nt, Homo sapiens
guucauggaugucuaucagcgca

SEQ ID NO: 1666 - RNA, 23 nt, Homo sapiens
uucauggaugucuaucagcgcag

SEQ ID NO: 1667 - RNA, 23 nt, Homo sapiens
ucauggaugucuaucagcgcagc

SEQ ID NO: 1668 - RNA, 23 nt, Homo sapiens
cauggaugucuaucagcgcagcu

SEQ ID NO: 1669 - RNA, 23 nt, Homo sapiens
auggaugucuaucagcgcagcua

SEQ ID NO: 1670 - RNA, 23 nt, Homo sapiens
uggaugucuaucagcgcagcuac

SEQ ID NO: 1671 - RNA, 23 nt, Homo sapiens
ggaugucuaucagcgcagcuacu

SEQ ID NO: 1672 - RNA, 23 nt, Homo sapiens
gaugucuaucagcgcagcuacug

SEQ ID NO: 1673 - RNA, 23 nt, Homo sapiens
augucuaucagcgcagcuacugc

SEQ ID NO: 1674 - RNA, 23 nt, Homo sapiens
ugucuaucagcgcagcuacugcc

SEQ ID NO: 1675 - RNA, 23 nt, Homo sapiens
gucuaucagcgcagcuacugcca

SEQ ID NO: 1676 - RNA, 23 nt, Homo sapiens
ucuaucagcgcagcuacugccau

SEQ ID NO: 1677 - RNA, 23 nt, Homo sapiens
cuaucagcgcagcuacugccauc

SEQ ID NO: 1678 - RNA, 23 nt, Homo sapiens
uaucagcgcagcuacugccaucc

SEQ ID NO: 1679 - RNA, 23 nt, Homo sapiens
aucagcgcagcuacugccaucca

SEQ ID NO: 1680 - RNA, 23 nt, Homo sapiens
ucagcgcagcuacugccauccaa

SEQ ID NO: 1681 - RNA, 23 nt, Homo sapiens
cagcgcagcuacugccauccaau

SEQ ID NO: 1682 - RNA, 23 nt, Homo sapiens
agcgcagcuacugccauccaauc

SEQ ID NO: 1683 - RNA, 23 nt, Homo sapiens
gcgcagcuacugccauccaaucg

SEQ ID NO: 1684 - RNA, 23 nt, Homo sapiens
cgcagcuacugccauccaaucga

SEQ ID NO: 1685 - RNA, 23 nt, Homo sapiens
gcagcuacugccauccaaucgag

SEQ ID NO: 1686 - RNA, 23 nt, Homo sapiens
cagcuacugccauccaaucgaga

SEQ ID NO: 1687 - RNA, 23 nt, Homo sapiens
agcuacugccauccaaucgagac

SEQ ID NO: 1688 - RNA, 23 nt, Homo sapiens
gcuacugccauccaaucgagacc

SEQ ID NO: 1689 - RNA, 23 nt, Homo sapiens
cuacugccauccaaucgagaccc

SEQ ID NO: 1690 - RNA, 23 nt, Homo sapiens
uacugccauccaaucgagacccu

SEQ ID NO: 1691 - RNA, 23 nt, Homo sapiens
acugccauccaaucgagacccug

SEQ ID NO: 1692 - RNA, 23 nt, Homo sapiens
cugccauccaaucgagacccugg

SEQ ID NO: 1693 - RNA, 23 nt, Homo sapiens
ugccauccaaucgagacccuggu

SEQ ID NO: 1694 - RNA, 23 nt, Homo sapiens
gccauccaaucgagacccuggug

SEQ ID NO: 1695 - RNA, 23 nt, Homo sapiens
ccauccaaucgagacccuggugg

SEQ ID NO: 1696 - RNA, 23 nt, Homo sapiens
cauccaaucgagacccuggugga

SEQ ID NO: 1697 - RNA, 23 nt, Homo sapiens
auccaaucgagacccugguggac

SEQ ID NO: 1698 - RNA, 23 nt, Homo sapiens
uccaaucgagacccugguggaca

SEQ ID NO: 1699 - RNA, 23 nt, Homo sapiens
ccaaucgagacccugguggacau

SEQ ID NO: 1700 - RNA, 23 nt, Homo sapiens
caaucgagacccugguggacauc

SEQ ID NO: 1701 - RNA, 23 nt, Homo sapiens
aaucgagacccugguggacaucu

SEQ ID NO: 1702 - RNA, 23 nt, Homo sapiens
aucgagacccugguggacaucuu

SEQ ID NO: 1703 - RNA, 23 nt, Homo sapiens
ucgagacccugguggacaucuuc

SEQ ID NO: 1704 - RNA, 23 nt, Homo sapiens
cgagacccugguggacaucuucc

SEQ ID NO: 1705 - RNA, 23 nt, Homo sapiens
gagacccugguggacaucuucca

SEQ ID NO: 1706 - RNA, 23 nt, Homo sapiens
agacccugguggacaucuuccag

SEQ ID NO: 1707 - RNA, 23 nt, Homo sapiens
gacccugguggacaucuuccagg

SEQ ID NO: 1708 - RNA, 23 nt, Homo sapiens
acccugguggacaucuuccagga

SEQ ID NO: 1709 - RNA, 23 nt, Homo sapiens
cccugguggacaucuuccaggag

SEQ ID NO: 1710 - RNA, 23 nt, Homo sapiens
ccugguggacaucuuccaggagu

SEQ ID NO: 1711 - RNA, 23 nt, Homo sapiens
cugguggacaucuuccaggagua

SEQ ID NO: 1712 - RNA, 23 nt, Homo sapiens
ugguggacaucuuccaggaguac

SEQ ID NO: 1713 - RNA, 23 nt, Homo sapiens
gguggacaucuuccaggaguacc

SEQ ID NO: 1714 - RNA, 23 nt, Homo sapiens
guggacaucuuccaggaguaccc

SEQ ID NO: 1715 - RNA, 23 nt, Homo sapiens
uggacaucuuccaggaguacccu

SEQ ID NO: 1716 - RNA, 23 nt, Homo sapiens
ggacaucuuccaggaguacccug

SEQ ID NO: 1717 - RNA, 23 nt, Homo sapiens
gacaucuuccaggaguacccuga

SEQ ID NO: 1718 - RNA, 23 nt, Homo sapiens
acaucuuccaggaguacccugau

SEQ ID NO: 1719 - RNA, 23 nt, Homo sapiens
caucuuccaggaguacccugaug

SEQ ID NO: 1720 - RNA, 23 nt, Homo sapiens
aucuuccaggaguacccugauga

SEQ ID NO: 1721 - RNA, 23 nt, Homo sapiens
ucuuccaggaguacccugaugag

SEQ ID NO: 1722 - RNA, 23 nt, Homo sapiens
cuuccaggaguacccugaugaga

SEQ ID NO: 1723 - RNA, 23 nt, Homo sapiens
uuccaggaguacccugaugagau

SEQ ID NO: 1724 - RNA, 23 nt, Homo sapiens
uccaggaguacccugaugagauc

SEQ ID NO: 1725 - RNA, 23 nt, Homo sapiens
ccaggaguacccugaugagaucg

SEQ ID NO: 1726 - RNA, 23 nt, Homo sapiens
caggaguacccugaugagaucga

SEQ ID NO: 1727 - RNA, 23 nt, Homo sapiens
aggaguacccugaugagaucgag

SEQ ID NO: 1728 - RNA, 23 nt, Homo sapiens
ggaguacccugaugagaucgagu

SEQ ID NO: 1729 - RNA, 23 nt, Homo sapiens
gaguacccugaugagaucgagua

SEQ ID NO: 1730 - RNA, 23 nt, Homo sapiens
aguacccugaugagaucgaguac

SEQ ID NO: 1731 - RNA, 23 nt, Homo sapiens
guacccugaugagaucgaguaca

SEQ ID NO: 1732 - RNA, 23 nt, Homo sapiens
uacccugaugagaucgaguacau

SEQ ID NO: 1733 - RNA, 23 nt, Homo sapiens
acccugaugagaucgaguacauc

SEQ ID NO: 1734 - RNA, 23 nt, Homo sapiens
cccugaugagaucgaguacaucu

SEQ ID NO: 1735 - RNA, 23 nt, Homo sapiens
ccugaugagaucgaguacaucuu

SEQ ID NO: 1736 - RNA, 23 nt, Homo sapiens
cugaugagaucgaguacaucuuc

SEQ ID NO: 1737 - RNA, 23 nt, Homo sapiens
ugaugagaucgaguacaucuuca

SEQ ID NO: 1738 - RNA, 23 nt, Homo sapiens
gaugagaucgaguacaucuucaa

SEQ ID NO: 1739 - RNA, 23 nt, Homo sapiens
augagaucgaguacaucuucaag

SEQ ID NO: 1740 - RNA, 23 nt, Homo sapiens
ugagaucgaguacaucuucaagc

SEQ ID NO: 1741 - RNA, 23 nt, Homo sapiens
gagaucgaguacaucuucaagcc

SEQ ID NO: 1742 - RNA, 23 nt, Homo sapiens
agaucgaguacaucuucaagcca

SEQ ID NO: 1743 - RNA, 23 nt, Homo sapiens
gaucgaguacaucuucaagccau

SEQ ID NO: 1744 - RNA, 23 nt, Homo sapiens
aucgaguacaucuucaagccauc

SEQ ID NO: 1745 - RNA, 23 nt, Homo sapiens
ucgaguacaucuucaagccaucc

SEQ ID NO: 1746 - RNA, 23 nt, Homo sapiens
cgaguacaucuucaagccauccu

SEQ ID NO: 1747 - RNA, 23 nt, Homo sapiens
gaguacaucuucaagccauccug

SEQ ID NO: 1748 - RNA, 23 nt, Homo sapiens
aguacaucuucaagccauccugu

SEQ ID NO: 1749 - RNA, 23 nt, Homo sapiens
guacaucuucaagccauccugug

SEQ ID NO: 1750 - RNA, 23 nt, Homo sapiens
uacaucuucaagccauccugugu

SEQ ID NO: 1751 - RNA, 23 nt, Homo sapiens
acaucuucaagccauccugugug

SEQ ID NO: 1752 - RNA, 23 nt, Homo sapiens
caucuucaagccauccugugugc

SEQ ID NO: 1753 - RNA, 23 nt, Homo sapiens
aucuucaagccauccugugugcc

SEQ ID NO: 1754 - RNA, 23 nt, Homo sapiens
ucuucaagccauccugugugccc

SEQ ID NO: 1755 - RNA, 23 nt, Homo sapiens
cuucaagccauccugugugcccc

SEQ ID NO: 1756 - RNA, 23 nt, Homo sapiens
uucaagccauccugugugccccu

SEQ ID NO: 1757 - RNA, 23 nt, Homo sapiens
ucaagccauccugugugccccug

SEQ ID NO: 1758 - RNA, 23 nt, Homo sapiens
caagccauccugugugccccuga

SEQ ID NO: 1759 - RNA, 23 nt, Homo sapiens
aagccauccugugugccccugau

SEQ ID NO: 1760 - RNA, 23 nt, Homo sapiens
agccauccugugugccccugaug

SEQ ID NO: 1761 - RNA, 23 nt, Homo sapiens
gccauccugugugccccugaugc

SEQ ID NO: 1762 - RNA, 23 nt, Homo sapiens
ccauccugugugccccugaugcg

SEQ ID NO: 1763 - RNA, 23 nt, Homo sapiens
cauccugugugccccugaugcga

SEQ ID NO: 1764 - RNA, 23 nt, Homo sapiens
auccugugugccccugaugcgau

SEQ ID NO: 1765 - RNA, 23 nt, Homo sapiens
uccugugugccccugaugcgaug

SEQ ID NO: 1766 - RNA, 23 nt, Homo sapiens
ccugugugccccugaugcgaugc

SEQ ID NO: 1767 - RNA, 23 nt, Homo sapiens
cugugugccccugaugcgaugcg

SEQ ID NO: 1768 - RNA, 23 nt, Homo sapiens
ugugugccccugaugcgaugcgg

SEQ ID NO: 1769 - RNA, 23 nt, Homo sapiens
gugugccccugaugcgaugcggg

SEQ ID NO: 1770 - RNA, 23 nt, Homo sapiens
ugugccccugaugcgaugcgggg

SEQ ID NO: 1771 - RNA, 23 nt, Homo sapiens
gugccccugaugcgaugcggggg

SEQ ID NO: 1772 - RNA, 23 nt, Homo sapiens
ugccccugaugcgaugcgggggc

SEQ ID NO: 1773 - RNA, 23 nt, Homo sapiens
gccccugaugcgaugcgggggcu

SEQ ID NO: 1774 - RNA, 23 nt, Homo sapiens
ccccugaugcgaugcgggggcug

SEQ ID NO: 1775 - RNA, 23 nt, Homo sapiens
cccugaugcgaugcgggggcugc

SEQ ID NO: 1776 - RNA, 23 nt, Homo sapiens
ccugaugcgaugcgggggcugcu

SEQ ID NO: 1777 - RNA, 23 nt, Homo sapiens
cugaugcgaugcgggggcugcug

SEQ ID NO: 1778 - RNA, 23 nt, Homo sapiens
ugaugcgaugcgggggcugcugc

SEQ ID NO: 1779 - RNA, 23 nt, Homo sapiens
gaugcgaugcgggggcugcugca

SEQ ID NO: 1780 - RNA, 23 nt, Homo sapiens
augcgaugcgggggcugcugcaa

SEQ ID NO: 1781 - RNA, 23 nt, Homo sapiens
ugcgaugcgggggcugcugcaau

SEQ ID NO: 1782 - RNA, 23 nt, Homo sapiens
gcgaugcgggggcugcugcaaug

SEQ ID NO: 1783 - RNA, 23 nt, Homo sapiens
cgaugcgggggcugcugcaauga

SEQ ID NO: 1784 - RNA, 23 nt, Homo sapiens
gaugcgggggcugcugcaaugac

SEQ ID NO: 1785 - RNA, 23 nt, Homo sapiens
augcgggggcugcugcaaugacg

SEQ ID NO: 1786 - RNA, 23 nt, Homo sapiens
ugcgggggcugcugcaaugacga

SEQ ID NO: 1787 - RNA, 23 nt, Homo sapiens
gcgggggcugcugcaaugacgag

SEQ ID NO: 1788 - RNA, 23 nt, Homo sapiens
cgggggcugcugcaaugacgagg

SEQ ID NO: 1789 - RNA, 23 nt, Homo sapiens
gggggcugcugcaaugacgaggg

SEQ ID NO: 1790 - RNA, 23 nt, Homo sapiens
ggggcugcugcaaugacgagggc

SEQ ID NO: 1791 - RNA, 23 nt, Homo sapiens
gggcugcugcaaugacgagggcc

SEQ ID NO: 1792 - RNA, 23 nt, Homo sapiens
ggcugcugcaaugacgagggccu

SEQ ID NO: 1793 - RNA, 23 nt, Homo sapiens
gcugcugcaaugacgagggccug

SEQ ID NO: 1794 - RNA, 23 nt, Homo sapiens
cugcugcaaugacgagggccugg

SEQ ID NO: 1795 - RNA, 23 nt, Homo sapiens
ugcugcaaugacgagggccugga

SEQ ID NO: 1796 - RNA, 23 nt, Homo sapiens
gcugcaaugacgagggccuggag

SEQ ID NO: 1797 - RNA, 23 nt, Homo sapiens
cugcaaugacgagggccuggagu

SEQ ID NO: 1798 - RNA, 23 nt, Homo sapiens
ugcaaugacgagggccuggagug

SEQ ID NO: 1799 - RNA, 23 nt, Homo sapiens
gcaaugacgagggccuggagugu

SEQ ID NO: 1800 - RNA, 23 nt, Homo sapiens
caaugacgagggccuggagugug

SEQ ID NO: 1801 - RNA, 23 nt, Homo sapiens
aaugacgagggccuggagugugu

SEQ ID NO: 1802 - RNA, 23 nt, Homo sapiens
augacgagggccuggagugugug

SEQ ID NO: 1803 - RNA, 23 nt, Homo sapiens
ugacgagggccuggagugugugc

SEQ ID NO: 1804 - RNA, 23 nt, Homo sapiens
gacgagggccuggagugugugcc

SEQ ID NO: 1805 - RNA, 23 nt, Homo sapiens
acgagggccuggagugugugccc

SEQ ID NO: 1806 - RNA, 23 nt, Homo sapiens
cgagggccuggagugugugccca

SEQ ID NO: 1807 - RNA, 23 nt, Homo sapiens
gagggccuggagugugugcccac

SEQ ID NO: 1808 - RNA, 23 nt, Homo sapiens
agggccuggagugugugcccacu

SEQ ID NO: 1809 - RNA, 23 nt, Homo sapiens
gggccuggagugugugcccacug

SEQ ID NO: 1810 - RNA, 23 nt, Homo sapiens
ggccuggagugugugcccacuga

SEQ ID NO: 1811 - RNA, 23 nt, Homo sapiens
gccuggagugugugcccacugag

SEQ ID NO: 1812 - RNA, 23 nt, Homo sapiens
ccuggagugugugcccacugagg

SEQ ID NO: 1813 - RNA, 23 nt, Homo sapiens
cuggagugugugcccacugagga

SEQ ID NO: 1814 - RNA, 23 nt, Homo sapiens
uggagugugugcccacugaggag

SEQ ID NO: 1815 - RNA, 23 nt, Homo sapiens
ggagugugugcccacugaggagu

SEQ ID NO: 1816 - RNA, 23 nt, Homo sapiens
gagugugugcccacugaggaguc

SEQ ID NO: 1817 - RNA, 23 nt, Homo sapiens
agugugugcccacugaggagucc

SEQ ID NO: 1818 - RNA, 23 nt, Homo sapiens
gugugugcccacugaggagucca

SEQ ID NO: 1819 - RNA, 23 nt, Homo sapiens
ugugugcccacugaggaguccaa

SEQ ID NO: 1820 - RNA, 23 nt, Homo sapiens
gugugcccacugaggaguccaac

SEQ ID NO: 1821 - RNA, 23 nt, Homo sapiens
ugugcccacugaggaguccaaca

SEQ ID NO: 1822 - RNA, 23 nt, Homo sapiens
gugcccacugaggaguccaacau

SEQ ID NO: 1823 - RNA, 23 nt, Homo sapiens
ugcccacugaggaguccaacauc

SEQ ID NO: 1824 - RNA, 23 nt, Homo sapiens
gcccacugaggaguccaacauca

SEQ ID NO: 1825 - RNA, 23 nt, Homo sapiens
cccacugaggaguccaacaucac

SEQ ID NO: 1826 - RNA, 23 nt, Homo sapiens
ccacugaggaguccaacaucacc

SEQ ID NO: 1827 - RNA, 23 nt, Homo sapiens
cacugaggaguccaacaucacca

SEQ ID NO: 1828 - RNA, 23 nt, Homo sapiens
acugaggaguccaacaucaccau

SEQ ID NO: 1829 - RNA, 23 nt, Homo sapiens
cugaggaguccaacaucaccaug

SEQ ID NO: 1830 - RNA, 23 nt, Homo sapiens
ugaggaguccaacaucaccaugc

SEQ ID NO: 1831 - RNA, 23 nt, Homo sapiens
gaggaguccaacaucaccaugca

SEQ ID NO: 1832 - RNA, 23 nt, Homo sapiens
aggaguccaacaucaccaugcag

SEQ ID NO: 1833 - RNA, 23 nt, Homo sapiens
ggaguccaacaucaccaugcaga

SEQ ID NO: 1834 - RNA, 23 nt, Homo sapiens
gaguccaacaucaccaugcagau

SEQ ID NO: 1835 - RNA, 23 nt, Homo sapiens
aguccaacaucaccaugcagauu

SEQ ID NO: 1836 - RNA, 23 nt, Homo sapiens
guccaacaucaccaugcagauua

SEQ ID NO: 1837 - RNA, 23 nt, Homo sapiens
uccaacaucaccaugcagauuau

SEQ ID NO: 1838 - RNA, 23 nt, Homo sapiens
ccaacaucaccaugcagauuaug

SEQ ID NO: 1839 - RNA, 23 nt, Homo sapiens
caacaucaccaugcagauuaugc

SEQ ID NO: 1840 - RNA, 23 nt, Homo sapiens
aacaucaccaugcagauuaugcg

SEQ ID NO: 1841 - RNA, 23 nt, Homo sapiens
acaucaccaugcagauuaugcgg

SEQ ID NO: 1842 - RNA, 23 nt, Homo sapiens
caucaccaugcagauuaugcgga

SEQ ID NO: 1843 - RNA, 23 nt, Homo sapiens
aucaccaugcagauuaugcggau

SEQ ID NO: 1844 - RNA, 23 nt, Homo sapiens
ucaccaugcagauuaugcggauc

SEQ ID NO: 1845 - RNA, 23 nt, Homo sapiens
caccaugcagauuaugcggauca

SEQ ID NO: 1846 - RNA, 23 nt, Homo sapiens
accaugcagauuaugcggaucaa

SEQ ID NO: 1847 - RNA, 23 nt, Homo sapiens
ccaugcagauuaugcggaucaaa

SEQ ID NO: 1848 - RNA, 23 nt, Homo sapiens
caugcagauuaugcggaucaaac

SEQ ID NO: 1849 - RNA, 23 nt, Homo sapiens
augcagauuaugcggaucaaacc

SEQ ID NO: 1850 - RNA, 23 nt, Homo sapiens
ugcagauuaugcggaucaaaccu

SEQ ID NO: 1851 - RNA, 23 nt, Homo sapiens
gcagauuaugcggaucaaaccuc

SEQ ID NO: 1852 - RNA, 23 nt, Homo sapiens
cagauuaugcggaucaaaccuca

SEQ ID NO: 1853 - RNA, 23 nt, Homo sapiens
agauuaugcggaucaaaccucac

SEQ ID NO: 1854 - RNA, 23 nt, Homo sapiens
gauuaugcggaucaaaccucacc

SEQ ID NO: 1855 - RNA, 23 nt, Homo sapiens
auuaugcggaucaaaccucacca

SEQ ID NO: 1856 - RNA, 23 nt, Homo sapiens
uuaugcggaucaaaccucaccaa

SEQ ID NO: 1857 - RNA, 23 nt, Homo sapiens
uaugcggaucaaaccucaccaag

SEQ ID NO: 1858 - RNA, 23 nt, Homo sapiens
augcggaucaaaccucaccaagg

SEQ ID NO: 1859 - RNA, 23 nt, Homo sapiens
ugcggaucaaaccucaccaaggc

SEQ ID NO: 1860 - RNA, 23 nt, Homo sapiens
gcggaucaaaccucaccaaggcc

SEQ ID NO: 1861 - RNA, 23 nt, Homo sapiens
cggaucaaaccucaccaaggcca

SEQ ID NO: 1862 - RNA, 23 nt, Homo sapiens
ggaucaaaccucaccaaggccag

SEQ ID NO: 1863 - RNA, 23 nt, Homo sapiens
gaucaaaccucaccaaggccagc

SEQ ID NO: 1864 - RNA, 23 nt, Homo sapiens
aucaaaccucaccaaggccagca

SEQ ID NO: 1865 - RNA, 23 nt, Homo sapiens
ucaaaccucaccaaggccagcac

SEQ ID NO: 1866 - RNA, 23 nt, Homo sapiens
caaaccucaccaaggccagcaca

SEQ ID NO: 1867 - RNA, 23 nt, Homo sapiens
aaaccucaccaaggccagcacau

SEQ ID NO: 1868 - RNA, 23 nt, Homo sapiens
aaccucaccaaggccagcacaua

SEQ ID NO: 1869 - RNA, 23 nt, Homo sapiens
accucaccaaggccagcacauag

SEQ ID NO: 1870 - RNA, 23 nt, Homo sapiens
ccucaccaaggccagcacauagg

SEQ ID NO: 1871 - RNA, 23 nt, Homo sapiens
cucaccaaggccagcacauagga

SEQ ID NO: 1872 - RNA, 23 nt, Homo sapiens
ucaccaaggccagcacauaggag

SEQ ID NO: 1873 - RNA, 23 nt, Homo sapiens
caccaaggccagcacauaggaga

SEQ ID NO: 1874 - RNA, 23 nt, Homo sapiens
accaaggccagcacauaggagag

SEQ ID NO: 1875 - RNA, 23 nt, Homo sapiens
ccaaggccagcacauaggagaga

SEQ ID NO: 1876 - RNA, 23 nt, Homo sapiens
caaggccagcacauaggagagau

SEQ ID NO: 1877 - RNA, 23 nt, Homo sapiens
aaggccagcacauaggagagaug

SEQ ID NO: 1878 - RNA, 23 nt, Homo sapiens
aggccagcacauaggagagauga

SEQ ID NO: 1879 - RNA, 23 nt, Homo sapiens
ggccagcacauaggagagaugag

SEQ ID NO: 1880 - RNA, 23 nt, Homo sapiens
gccagcacauaggagagaugagc

SEQ ID NO: 1881 - RNA, 23 nt, Homo sapiens
ccagcacauaggagagaugagcu

SEQ ID NO: 1882 - RNA, 23 nt, Homo sapiens
cagcacauaggagagaugagcuu

SEQ ID NO: 1883 - RNA, 23 nt, Homo sapiens
agcacauaggagagaugagcuuc

SEQ ID NO: 1884 - RNA, 23 nt, Homo sapiens
gcacauaggagagaugagcuucc

SEQ ID NO: 1885 - RNA, 23 nt, Homo sapiens
cacauaggagagaugagcuuccu

SEQ ID NO: 1886 - RNA, 23 nt, Homo sapiens
acauaggagagaugagcuuccua

SEQ ID NO: 1887 - RNA, 23 nt, Homo sapiens
cauaggagagaugagcuuccuac

SEQ ID NO: 1888 - RNA, 23 nt, Homo sapiens
auaggagagaugagcuuccuaca

SEQ ID NO: 1889 - RNA, 23 nt, Homo sapiens
uaggagagaugagcuuccuacag

SEQ ID NO: 1890 - RNA, 23 nt, Homo sapiens
aggagagaugagcuuccuacagc

SEQ ID NO: 1891 - RNA, 23 nt, Homo sapiens
ggagagaugagcuuccuacagca

SEQ ID NO: 1892 - RNA, 23 nt, Homo sapiens
gagagaugagcuuccuacagcac

SEQ ID NO: 1893 - RNA, 23 nt, Homo sapiens
agagaugagcuuccuacagcaca

SEQ ID NO: 1894 - RNA, 23 nt, Homo sapiens
gagaugagcuuccuacagcacaa

SEQ ID NO: 1895 - RNA, 23 nt, Homo sapiens
agaugagcuuccuacagcacaac

SEQ ID NO: 1896 - RNA, 23 nt, Homo sapiens
gaugagcuuccuacagcacaaca

SEQ ID NO: 1897 - RNA, 23 nt, Homo sapiens
augagcuuccuacagcacaacaa

SEQ ID NO: 1898 - RNA, 23 nt, Homo sapiens
ugagcuuccuacagcacaacaaa

SEQ ID NO: 1899 - RNA, 23 nt, Homo sapiens
gagcuuccuacagcacaacaaau

SEQ ID NO: 1900 - RNA, 23 nt, Homo sapiens
agcuuccuacagcacaacaaaug

SEQ ID NO: 1901 - RNA, 23 nt, Homo sapiens
gcuuccuacagcacaacaaaugu

SEQ ID NO: 1902 - RNA, 23 nt, Homo sapiens
cuuccuacagcacaacaaaugug

SEQ ID NO: 1903 - RNA, 23 nt, Homo sapiens
uuccuacagcacaacaaauguga

SEQ ID NO: 1904 - RNA, 23 nt, Homo sapiens
uccuacagcacaacaaaugugaa

SEQ ID NO: 1905 - RNA, 23 nt, Homo sapiens
ccuacagcacaacaaaugugaau

SEQ ID NO: 1906 - RNA, 23 nt, Homo sapiens
cuacagcacaacaaaugugaaug

SEQ ID NO: 1907 - RNA, 23 nt, Homo sapiens
uacagcacaacaaaugugaaugc

SEQ ID NO: 1908 - RNA, 23 nt, Homo sapiens
acagcacaacaaaugugaaugca

SEQ ID NO: 1909 - RNA, 23 nt, Homo sapiens
cagcacaacaaaugugaaugcag

SEQ ID NO: 1910 - RNA, 23 nt, Homo sapiens
agcacaacaaaugugaaugcaga

SEQ ID NO: 1911 - RNA, 23 nt, Homo sapiens
gcacaacaaaugugaaugcagac

SEQ ID NO: 1912 - RNA, 23 nt, Homo sapiens
cacaacaaaugugaaugcagacc

SEQ ID NO: 1913 - RNA, 23 nt, Homo sapiens
acaacaaaugugaaugcagacca

SEQ ID NO: 1914 - RNA, 23 nt, Homo sapiens
caacaaaugugaaugcagaccaa

SEQ ID NO: 1915 - RNA, 23 nt, Homo sapiens
aacaaaugugaaugcagaccaaa

SEQ ID NO: 1916 - RNA, 23 nt, Homo sapiens
acaaaugugaaugcagaccaaag

SEQ ID NO: 1917 - RNA, 23 nt, Homo sapiens
caaaugugaaugcagaccaaaga

SEQ ID NO: 1918 - RNA, 23 nt, Homo sapiens
aaaugugaaugcagaccaaagaa

SEQ ID NO: 1919 - RNA, 23 nt, Homo sapiens
aaugugaaugcagaccaaagaaa

SEQ ID NO: 1920 - RNA, 23 nt, Homo sapiens
augugaaugcagaccaaagaaag

SEQ ID NO: 1921 - RNA, 23 nt, Homo sapiens
ugugaaugcagaccaaagaaaga

SEQ ID NO: 1922 - RNA, 23 nt, Homo sapiens
gugaaugcagaccaaagaaagau

SEQ ID NO: 1923 - RNA, 23 nt, Homo sapiens
ugaaugcagaccaaagaaagaua

SEQ ID NO: 1924 - RNA, 23 nt, Homo sapiens
gaaugcagaccaaagaaagauag

SEQ ID NO: 1925 - RNA, 23 nt, Homo sapiens
aaugcagaccaaagaaagauaga

SEQ ID NO: 1926 - RNA, 23 nt, Homo sapiens
augcagaccaaagaaagauagag

SEQ ID NO: 1927 - RNA, 23 nt, Homo sapiens
ugcagaccaaagaaagauagagc

SEQ ID NO: 1928 - RNA, 23 nt, Homo sapiens
gcagaccaaagaaagauagagca

SEQ ID NO: 1929 - RNA, 23 nt, Homo sapiens
cagaccaaagaaagauagagcaa

SEQ ID NO: 1930 - RNA, 23 nt, Homo sapiens
agaccaaagaaagauagagcaag

SEQ ID NO: 1931 - RNA, 23 nt, Homo sapiens
gaccaaagaaagauagagcaaga

SEQ ID NO: 1932 - RNA, 23 nt, Homo sapiens
accaaagaaagauagagcaagac

SEQ ID NO: 1933 - RNA, 23 nt, Homo sapiens
ccaaagaaagauagagcaagaca

SEQ ID NO: 1934 - RNA, 23 nt, Homo sapiens
caaagaaagauagagcaagacaa

SEQ ID NO: 1935 - RNA, 23 nt, Homo sapiens
aaagaaagauagagcaagacaag

SEQ ID NO: 1936 - RNA, 23 nt, Homo sapiens
aagaaagauagagcaagacaaga

SEQ ID NO: 1937 - RNA, 23 nt, Homo sapiens
agaaagauagagcaagacaagaa

SEQ ID NO: 1938 - RNA, 23 nt, Homo sapiens
gaaagauagagcaagacaagaaa

SEQ ID NO: 1939 - RNA, 23 nt, Homo sapiens
aaagauagagcaagacaagaaaa

SEQ ID NO: 1940 - RNA, 21 nt, Artificial Sequence
  Description of Artificial Sequence: Synthetic oligonucleotide
gaacuuucugcugucuugggu

SEQ ID NO: 1941 - RNA, 23 nt, Artificial Sequence
  Description of Artificial Sequence: Synthetic oligonucleotide
acccaagacagcagaaaguucau

SEQ ID NO: 1942 - RNA, 21 nt, Artificial Sequence
  Description of Artificial Sequence: Synthetic oligonucleotide
gcauuggagccuugccuugcu

SEQ ID NO: 1943 - RNA, 23 nt, Artificial Sequence
  Description of Artificial Sequence: Synthetic oligonucleotide
agcaaggcaaggcuccaaugcac

SEQ ID NO: 1944 - DNA, 21 bp, Artificial Sequence
  Description of Combined DNA/RNA Molecule: Synthetic oligonucleotide
  Description of Artificial Sequence: Synthetic oligonucleotide
uaccuccaccaugccaagutt

SEQ ID NO: 1945 - DNA, 21 bp, Artificial Sequence
  Description of Combined DNA/RNA Molecule: Synthetic oligonucleotide
  Description of Artificial Sequence: Synthetic oligonucleotide
acuuggcaugguggagguatt

SEQ ID NO: 1946 - DNA, 21 bp, Artificial Sequence
  Description of Combined DNA/RNA Molecule: Synthetic oligonucleotide
  Description of Artificial Sequence: Synthetic oligonucleotide
accuccaccaugccaagugtt

SEQ ID NO: 1947 - DNA, 21 bp, Artificial Sequence
  Description of Combined DNA/RNA Molecule: Synthetic oligonucleotide
  Description of Artificial Sequence: Synthetic oligonucleotide
cacuuggcaugguggaggutt

SEQ ID NO: 1948 - RNA, 21 nt, Artificial Sequence
  Description of Artificial Sequence: Synthetic oligonucleotide
cuccaccaugccaaguggucc

SEQ ID NO: 1949 - RNA, 23 nt, Artificial Sequence
  Description of Artificial Sequence: Synthetic oligonucleotide
ggaccacuuggcaugguggaggu

SEQ ID NO: 1950 - DNA, 21 bp, Artificial Sequence
  Description of Combined DNA/RNA Molecule: Synthetic oligonucleotide
  Description of Artificial Sequence: Synthetic oligonucleotide
cuccaccaugccaaguggutt

SEQ ID NO: 1951 - DNA, 21 bp, Artificial Sequence
  Description of Combined DNA/RNA Molecule: Synthetic oligonucleotide
  Description of Artificial Sequence: Synthetic oligonucleotide
accacuuggcaugguggagtt

SEQ ID NO: 1952 - RNA, 21 nt, Artificial Sequence
  Description of Artificial Sequence: Synthetic oligonucleotide
uccaccaugccaagugguccc

SEQ ID NO: 1953 - RNA, 23 nt, Artificial Sequence
  Description of Artificial Sequence: Synthetic oligonucleotide
gggaccacuuggcaugguggagg

SEQ ID NO: 1954 - DNA, 21 bp, Artificial Sequence
  Description of Combined DNA/RNA Molecule: Synthetic oligonucleotide
  Description of Artificial Sequence: Synthetic oligonucleotide
uccaccaugccaagugguctt

SEQ ID NO: 1955 - DNA, 21 bp, Artificial Sequence
  Description of Combined DNA/RNA Molecule: Synthetic oligonucleotide
  Description of Artificial Sequence: Synthetic oligonucleotide
gaccacuuggcaugguggatt

SEQ ID NO: 1956 - RNA, 21 nt, Artificial Sequence
  Description of Artificial Sequence: Synthetic oligonucleotide
ccaccaugccaagugguccca

SEQ ID NO: 1957 - RNA, 23 nt, Artificial Sequence
  Description of Artificial Sequence: Synthetic oligonucleotide
ugggaccacuuggcaugguggag

SEQ ID NO: 1958 - DNA, 21 bp, Artificial Sequence
  Description of Combined DNA/RNA Molecule: Synthetic oligonucleotide
  Description of Artificial Sequence: Synthetic oligonucleotide
ccaccaugccaaguggucctt

SEQ ID NO: 1959 - DNA, 21 bp, Artificial Sequence
  Description of Combined DNA/RNA Molecule: Synthetic oligonucleotide
  Description of Artificial Sequence: Synthetic oligonucleotide
ggaccacuuggcaugguggtt

SEQ ID NO: 1960 - RNA, 21 nt, Artificial Sequence
  Description of Artificial Sequence: Synthetic oligonucleotide
caccaugccaaguggucccag

SEQ ID NO: 1961 - RNA, 23 nt, Artificial Sequence
  Description of Artificial Sequence: Synthetic oligonucleotide
cugggaccacuuggcauggugga

SEQ ID NO: 1962 - DNA, 21 bp, Artificial Sequence
  Description of Combined DNA/RNA Molecule: Synthetic oligonucleotide
  Description of Artificial Sequence: Synthetic oligonucleotide
caccaugccaagugguccctt

SEQ ID NO: 1963 - DNA, 21 bp, Artificial Sequence
  Description of Combined DNA/RNA Molecule: Synthetic oligonucleotide
  Description of Artificial Sequence: Synthetic oligonucleotide
gggaccacuuggcauggugtt

SEQ ID NO: 1964 - RNA, 21 nt, Artificial Sequence
  Description of Artificial Sequence: Synthetic oligonucleotide
accaugccaaguggucccagg

SEQ ID NO: 1965 - RNA, 23 nt, Artificial Sequence
  Description of Artificial Sequence: Synthetic oligonucleotide
ccugggaccacuuggcauggugg

SEQ ID NO: 1966 - DNA, 21 bp, Artificial Sequence
  Description of Combined DNA/RNA Molecule: Synthetic oligonucleotide
  Description of Artificial Sequence: Synthetic oligonucleotide
accaugccaaguggucccatt

SEQ ID NO: 1967 - DNA, 21 bp, Artificial Sequence
  Description of Combined DNA/RNA Molecule: Synthetic oligonucleotide
  Description of Artificial Sequence: Synthetic oligonucleotide
ugggaccacuuggcauggutt

SEQ ID NO: 1968 - RNA, 21 nt, Artificial Sequence
  Description of Artificial Sequence: Synthetic oligonucleotide
ccaugccaaguggucccaggc

SEQ ID NO: 1969 - RNA, 23 nt, Artificial Sequence
  Description of Artificial Sequence: Synthetic oligonucleotide
gccugggaccacuuggcauggug

SEQ ID NO: 1970 - DNA, 21 bp, Artificial Sequence
  Description of Combined DNA/RNA Molecule: Synthetic oligonucleotide
  Description of Artificial Sequence: Synthetic oligonucleotide
ccaugccaaguggucccagtt

SEQ ID NO: 1971 - DNA, 21 bp, Artificial Sequence
  Description of Combined DNA/RNA Molecule: Synthetic oligonucleotide
  Description of Artificial Sequence: Synthetic oligonucleotide
cugggaccacuuggcauggtt

SEQ ID NO: 1972 - RNA, 21 nt, Artificial Sequence
  Description of Artificial Sequence: Synthetic oligonucleotide
caugccaaguggucccaggcu

SEQ ID NO: 1973 - RNA, 23 nt, Artificial Sequence
  Description of Artificial Sequence: Synthetic oligonucleotide
agccugggaccacuuggcauggu

SEQ ID NO: 1974 - DNA, 21 bp, Artificial Sequence
  Description of Combined DNA/RNA Molecule: Synthetic oligonucleotide
  Description of Artificial Sequence: Synthetic oligonucleotide
caugccaaguggucccaggtt

SEQ ID NO: 1975 - DNA, 21 bp, Artificial Sequence
  Description of Combined DNA/RNA Molecule: Synthetic oligonucleotide
  Description of Artificial Sequence: Synthetic oligonucleotide
ccugggaccacuuggcaugtt

SEQ ID NO: 1976 - RNA, 21 nt, Artificial Sequence
  Description of Artificial Sequence: Synthetic oligonucleotide
augccaaguggucccaggcug

SEQ ID NO: 1977 - RNA, 23 nt, Artificial Sequence
  Description of Artificial Sequence: Synthetic oligonucleotide
cagccugggaccacuuggcaugg

SEQ ID NO: 1978 - DNA, 21 bp, Artificial Sequence
  Description of Combined DNA/RNA Molecule: Synthetic oligonucleotide
  Description of Artificial Sequence: Synthetic oligonucleotide
augccaaguggucccaggctt

SEQ ID NO: 1979 - DNA, 21 bp, Artificial Sequence
  Description of Combined DNA/RNA Molecule: Synthetic oligonucleotide
  Description of Artificial Sequence: Synthetic oligonucleotide
gccugggaccacuuggcautt

SEQ ID NO: 1980 - RNA, 21 nt, Artificial Sequence
  Description of Artificial Sequence: Synthetic oligonucleotide
ugccaaguggucccaggcugc

SEQ ID NO: 1981 - RNA, 23 nt, Artificial Sequence
  Description of Artificial Sequence: Synthetic oligonucleotide
gcagccugggaccacuuggcaug

SEQ ID NO: 1982 - DNA, 21 bp, Artificial Sequence
  Description of Combined DNA/RNA Molecule: Synthetic oligonucleotide
  Description of Artificial Sequence: Synthetic oligonucleotide
ugccaaguggucccaggcutt

SEQ ID NO: 1983 - DNA, 21 bp, Artificial Sequence
  Description of Combined DNA/RNA Molecule: Synthetic oligonucleotide
  Description of Artificial Sequence: Synthetic oligonucleotide
agccugggaccacuuggcatt

SEQ ID NO: 1984 - RNA, 21 nt, Artificial Sequence
  Description of Artificial Sequence: Synthetic oligonucleotide
gccaaguggucccaggcugca

SEQ ID NO: 1985 - RNA, 23 nt, Artificial Sequence
  Description of Artificial Sequence: Synthetic oligonucleotide
ugcagccugggaccacuuggcau

SEQ ID NO: 1986 - DNA, 21 bp, Artificial Sequence
  Description of Combined DNA/RNA Molecule: Synthetic oligonucleotide
  Description of Artificial Sequence: Synthetic oligonucleotide
gccaaguggucccaggcugtt

SEQ ID NO: 1987 - DNA, 21 bp, Artificial Sequence
  Description of Combined DNA/RNA Molecule: Synthetic oligonucleotide
  Description of Artificial Sequence: Synthetic oligonucleotide
cagccugggaccacuuggctt

SEQ ID NO: 1988 - RNA, 21 nt, Artificial Sequence
  Description of Artificial Sequence: Synthetic oligonucleotide
ccaaguggucccaggcugcac

SEQ ID NO: 1989 - RNA, 23 nt, Artificial Sequence
  Description of Artificial Sequence: Synthetic oligonucleotide
gugcagccugggaccacuuggca

SEQ ID NO: 1990 - DNA, 21 bp, Artificial Sequence
  Description of Combined DNA/RNA Molecule: Synthetic oligonucleotide
  Description of Artificial Sequence: Synthetic oligonucleotide
ccaaguggucccaggcugctt

SEQ ID NO: 1991 - DNA, 21 bp, Artificial Sequence
  Description of Combined DNA/RNA Molecule: Synthetic oligonucleotide
  Description of Artificial Sequence: Synthetic oligonucleotide
gcagccugggaccacuuggtt

SEQ ID NO: 1992 - RNA, 21 nt, Artificial Sequence
  Description of Artificial Sequence: Synthetic oligonucleotide
caaguggucccaggcugcacc

SEQ ID NO: 1993 - RNA, 23 nt, Artificial Sequence
  Description of Artificial Sequence: Synthetic oligonucleotide
ggugcagccugggaccacuuggc

SEQ ID NO: 1994 - DNA, 21 bp, Artificial Sequence
  Description of Combined DNA/RNA Molecule: Synthetic oligonucleotide
  Description of Artificial Sequence: Synthetic oligonucleotide
caaguggucccaggcugcatt

SEQ ID NO: 1995 - DNA, 21 bp, Artificial Sequence
  Description of Combined DNA/RNA Molecule: Synthetic oligonucleotide
  Description of Artificial Sequence: Synthetic oligonucleotide
ugcagccugggaccacuugtt

SEQ ID NO: 1996 - RNA, 21 nt, Artificial Sequence
  Description of Artificial Sequence: Synthetic oligonucleotide
aaguggucccaggcugcaccc

SEQ ID NO: 1997 - RNA, 23 nt, Artificial Sequence
  Description of Artificial Sequence: Synthetic oligonucleotide
gggugcagccugggaccacuugg

SEQ ID NO: 1998 - DNA, 21 bp, Artificial Sequence
  Description of Combined DNA/RNA Molecule: Synthetic oligonucleotide
  Description of Artificial Sequence: Synthetic oligonucleotide
aaguggucccaggcugcactt

SEQ ID NO: 1999 - DNA, 21 bp, Artificial Sequence
  Description of Combined DNA/RNA Molecule: Synthetic oligonucleotide
  Description of Artificial Sequence: Synthetic oligonucleotide
gugcagccugggaccacuutt

SEQ ID NO: 2000 - RNA, 21 nt, Artificial Sequence
  Description of Artificial Sequence: Synthetic oligonucleotide
aguggucccaggcugcaccca

SEQ ID NO: 2001 - RNA, 23 nt, Artificial Sequence
  Description of Artificial Sequence: Synthetic oligonucleotide
ugggugcagccugggaccacuug

SEQ ID NO: 2002 - DNA, 21 bp, Artificial Sequence
  Description of Combined DNA/RNA Molecule: Synthetic oligonucleotide
  Description of Artificial Sequence: Synthetic oligonucleotide
aguggucccaggcugcacctt

SEQ ID NO: 2003 - DNA, 21 bp, Artificial Sequence
  Description of Combined DNA/RNA Molecule: Synthetic oligonucleotide
  Description of Artificial Sequence: Synthetic oligonucleotide
ggugcagccugggaccacutt

SEQ ID NO: 2004 - DNA, 21 bp, Artificial Sequence
  Description of Combined DNA/RNA Molecule: Synthetic oligonucleotide
  Description of Artificial Sequence: Synthetic oligonucleotide
guggucccaggcugcaccctt

SEQ ID NO: 2005 - DNA, 21 bp, Artificial Sequence
  Description of Combined DNA/RNA Molecule: Synthetic oligonucleotide
  Description of Artificial Sequence: Synthetic oligonucleotide
gggugcagccugggaccactt

SEQ ID NO: 2006 - DNA, 21 bp, Artificial Sequence
  Description of Combined DNA/RNA Molecule: Synthetic oligonucleotide
  Description of Artificial Sequence: Synthetic oligonucleotide
ggcagaaucaucacgaagutt

SEQ ID NO: 2007 - DNA, 21 bp, Artificial Sequence
  Description of Combined DNA/RNA Molecule: Synthetic oligonucleotide
  Description of Artificial Sequence: Synthetic oligonucleotide
acuucgugaugauucugcctt

SEQ ID NO: 2008 - DNA, 21 bp, Artificial Sequence
  Description of Combined DNA/RNA Molecule: Synthetic oligonucleotide
  Description of Artificial Sequence: Synthetic oligonucleotide
gcagaaucaucacgaagugtt

SEQ ID NO: 2009 - DNA, 21 bp, Artificial Sequence
  Description of Combined DNA/RNA Molecule: Synthetic oligonucleotide
  Description of Artificial Sequence: Synthetic oligonucleotide
cacuucgugaugauucugctt

SEQ ID NO: 2010 - DNA, 21 bp, Artificial Sequence
  Description of Combined DNA/RNA Molecule: Synthetic oligonucleotide
  Description of Artificial Sequence: Synthetic oligonucleotide
cagaaucaucacgaaguggtt

SEQ ID NO: 2011 - DNA, 21 bp, Artificial Sequence
  Description of Combined DNA/RNA Molecule: Synthetic oligonucleotide
  Description of Artificial Sequence: Synthetic oligonucleotide
ccacuucgugaugauucugtt

SEQ ID NO: 2012 - RNA, 21 nt, Artificial Sequence
  Description of Artificial Sequence: Synthetic oligonucleotide
agaaucaucacgaagugguga

SEQ ID NO: 2013 - RNA, 23 nt, Artificial Sequence
  Description of Artificial Sequence: Synthetic oligonucleotide
ucaccacuucgugaugauucugc

SEQ ID NO: 2014 - DNA, 21 bp, Artificial Sequence
  Description of Combined DNA/RNA Molecule: Synthetic oligonucleotide
  Description of Artificial Sequence: Synthetic oligonucleotide
agaaucaucacgaaguggutt

SEQ ID NO: 2015 - DNA, 21 bp, Artificial Sequence
  Description of Combined DNA/RNA Molecule: Synthetic oligonucleotide
  Description of Artificial Sequence: Synthetic oligonucleotide
accacuucgugaugauucutt

SEQ ID NO: 2016 - DNA, 21 bp, Artificial Sequence
  Description of Combined DNA/RNA Molecule: Synthetic oligonucleotide
  Description of Artificial Sequence: Synthetic oligonucleotide
gaaucaucacgaaguggugtt

SEQ ID NO: 2017 - DNA, 21 bp, Artificial Sequence
  Description of Combined DNA/RNA Molecule: Synthetic oligonucleotide
  Description of Artificial Sequence: Synthetic oligonucleotide
caccacuucgugaugauuctt

SEQ ID NO: 2018 - DNA, 21 bp, Artificial Sequence
  Description of Combined DNA/RNA Molecule: Synthetic oligonucleotide
  Description of Artificial Sequence: Synthetic oligonucleotide
aaucaucacgaaguggugatt

SEQ ID NO: 2019 - DNA, 21 bp, Artificial Sequence
  Description of Combined DNA/RNA Molecule: Synthetic oligonucleotide
  Description of Artificial Sequence: Synthetic oligonucleotide
ucaccacuucgugaugauutt

SEQ ID NO: 2020 - DNA, 21 bp, Artificial Sequence
  Description of Combined DNA/RNA Molecule: Synthetic oligonucleotide
  Description of Artificial Sequence: Synthetic oligonucleotide
aucaucacgaaguggugaatt

SEQ ID NO: 2021 - DNA, 21 bp, Artificial Sequence
  Description of Combined DNA/RNA Molecule: Synthetic oligonucleotide
  Description of Artificial Sequence: Synthetic oligonucleotide
uucaccacuucgugaugautt

SEQ ID NO: 2022 - RNA, 21 nt, Artificial Sequence
  Description of Artificial Sequence: Synthetic oligonucleotide
gaaguggugaaguucauggau

SEQ ID NO: 2023 - RNA, 23 nt, Artificial Sequence
  Description of Artificial Sequence: Synthetic oligonucleotide
auccaugaacuucaccacuucgu

SEQ ID NO: 2024 - RNA, 21 nt, Artificial Sequence
  Description of Artificial Sequence: Synthetic oligonucleotide
gaaguucauggaugucuauca

SEQ ID NO: 2025 - RNA, 23 nt, Artificial Sequence
  Description of Artificial Sequence: Synthetic oligonucleotide
ugauagacauccaugaacuucac

SEQ ID NO: 2026 - DNA, 21 bp, Artificial Sequence
  Description of Combined DNA/RNA Molecule: Synthetic oligonucleotide
  Description of Artificial Sequence: Synthetic oligonucleotide
uggaugucuaucagcgcagtt

SEQ ID NO: 2027 - DNA, 21 bp, Artificial Sequence
  Description of Combined DNA/RNA Molecule: Synthetic oligonucleotide
  Description of Artificial Sequence: Synthetic oligonucleotide
cugcgcugauagacauccatt

SEQ ID NO: 2028 - RNA, 21 nt, Artificial Sequence
  Description of Artificial Sequence: Synthetic oligonucleotide
ggaugucuaucagcgcagcua

SEQ ID NO: 2029 - RNA, 23 nt, Artificial Sequence
  Description of Artificial Sequence: Synthetic oligonucleotide
uagcugcgcugauagacauccau

SEQ ID NO: 2030 - DNA, 21 bp, Artificial Sequence
  Description of Combined DNA/RNA Molecule: Synthetic oligonucleotide
  Description of Artificial Sequence: Synthetic oligonucleotide
ggaugucuaucagcgcagctt

SEQ ID NO: 2031 - DNA, 21 bp, Artificial Sequence
  Description of Combined DNA/RNA Molecule: Synthetic oligonucleotide
  Description of Artificial Sequence: Synthetic oligonucleotide
gcugcgcugauagacaucctt

SEQ ID NO: 2032 - DNA, 21 bp, Artificial Sequence
  Description of Combined DNA/RNA Molecule: Synthetic oligonucleotide
  Description of Artificial Sequence: Synthetic oligonucleotide
gaugucuaucagcgcagcutt

SEQ ID NO: 2033 - DNA, 21 bp, Artificial Sequence
  Description of Combined DNA/RNA Molecule: Synthetic oligonucleotide
  Description of Artificial Sequence: Synthetic oligonucleotide
agcugcgcugauagacauctt

SEQ ID NO: 2034 - DNA, 21 bp, Artificial Sequence
  Description of Combined DNA/RNA Molecule: Synthetic oligonucleotide
  Description of Artificial Sequence: Synthetic oligonucleotide
augucuaucagcgcagcuatt

SEQ ID NO: 2035 - DNA, 21 bp, Artificial Sequence
  Description of Combined DNA/RNA Molecule: Synthetic oligonucleotide
  Description of Artificial Sequence: Synthetic oligonucleotide
uagcugcgcugauagacautt

SEQ ID NO: 2036 - DNA, 21 bp, Artificial Sequence
  Description of Combined DNA/RNA Molecule: Synthetic oligonucleotide
  Description of Artificial Sequence: Synthetic oligonucleotide
ugucuaucagcgcagcuactt

SEQ ID NO: 2037 - DNA, 21 bp, Artificial Sequence
  Description of Combined DNA/RNA Molecule: Synthetic oligonucleotide
  Description of Artificial Sequence: Synthetic oligonucleotide
guagcugcgcugauagacatt

SEQ ID NO: 2038 - RNA, 21 nt, Artificial Sequence
  Description of Artificial Sequence: Synthetic oligonucleotide
gucuaucagcgcagcuacugc

SEQ ID NO: 2039 - RNA, 23 nt, Artificial Sequence
  Description of Artificial Sequence: Synthetic oligonucleotide
gcaguagcugcgcugauagacau

SEQ ID NO: 2040 - DNA, 21 bp, Artificial Sequence
  Description of Combined DNA/RNA Molecule: Synthetic oligonucleotide
  Description of Artificial Sequence: Synthetic oligonucleotide
gucuaucagcgcagcuacutt

SEQ ID NO: 2041 - DNA, 21 bp, Artificial Sequence
  Description of Combined DNA/RNA Molecule: Synthetic oligonucleotide
  Description of Artificial Sequence: Synthetic oligonucleotide
aguagcugcgcugauagactt

SEQ ID NO: 2042 - DNA, 21 bp, Artificial Sequence
  Description of Combined DNA/RNA Molecule: Synthetic oligonucleotide
  Description of Artificial Sequence: Synthetic oligonucleotide
ucuaucagcgcagcuacugtt

SEQ ID NO: 2043 - DNA, 21 bp, Artificial Sequence
  Description of Combined DNA/RNA Molecule: Synthetic oligonucleotide
  Description of Artificial Sequence: Synthetic oligonucleotide
caguagcugcgcugauagatt

SEQ ID NO: 2044 - RNA, 21 nt, Artificial Sequence
  Description of Artificial Sequence: Synthetic oligonucleotide
gcagcuacugccauccaaucg

SEQ ID NO: 2045 - RNA, 23 nt, Artificial Sequence
  Description of Artificial Sequence: Synthetic oligonucleotide
cgauuggauggcaguagcugcgc

SEQ ID NO: 2046 - RNA, 21 nt, Artificial Sequence
  Description of Artificial Sequence: Synthetic oligonucleotide
agcuacugccauccaaucgag

SEQ ID NO: 2047 - RNA, 23 nt, Artificial Sequence
  Description of Artificial Sequence: Synthetic oligonucleotide
cucgauuggauggcaguagcugc

SEQ ID NO: 2048 - DNA, 21 bp, Artificial Sequence
  Description of Combined DNA/RNA Molecule: Synthetic oligonucleotide
  Description of Artificial Sequence: Synthetic oligonucleotide
uacugccauccaaucgagatt

SEQ ID NO: 2049 - DNA, 21 bp, Artificial Sequence
  Description of Combined DNA/RNA Molecule: Synthetic oligonucleotide
  Description of Artificial Sequence: Synthetic oligonucleotide
ucucgauuggauggcaguatt

SEQ ID NO: 2050 - DNA, 21 bp, Artificial Sequence
  Description of Combined DNA/RNA Molecule: Synthetic oligonucleotide
  Description of Artificial Sequence: Synthetic oligonucleotide
acugccauccaaucgagactt

SEQ ID NO: 2051 - DNA, 21 bp, Artificial Sequence
  Description of Combined DNA/RNA Molecule: Synthetic oligonucleotide
  Description of Artificial Sequence: Synthetic oligonucleotide
gucucgauuggauggcagutt

SEQ ID NO: 2052 - DNA, 21 bp, Artificial Sequence
  Description of Combined DNA/RNA Molecule: Synthetic oligonucleotide
  Description of Artificial Sequence: Synthetic oligonucleotide
cugccauccaaucgagacctt

SEQ ID NO: 2053 - DNA, 21 bp, Artificial Sequence
  Description of Combined DNA/RNA Molecule: Synthetic oligonucleotide
  Description of Artificial Sequence: Synthetic oligonucleotide
ggucucgauuggauggcagtt

SEQ ID NO: 2054 - DNA, 21 bp, Artificial Sequence
  Description of Combined DNA/RNA Molecule: Synthetic oligonucleotide
  Description of Artificial Sequence: Synthetic oligonucleotide
ugccauccaaucgagaccctt

SEQ ID NO: 2055 - DNA, 21 bp, Artificial Sequence
  Description of Combined DNA/RNA Molecule: Synthetic oligonucleotide
  Description of Artificial Sequence: Synthetic oligonucleotide
gggucucgauuggauggcatt

SEQ ID NO: 2056 - RNA, 21 nt, Artificial Sequence
  Description of Artificial Sequence: Synthetic oligonucleotide
gacccugguggacaucuucca

SEQ ID NO: 2057 - RNA, 23 nt, Artificial Sequence
  Description of Artificial Sequence: Synthetic oligonucleotide
uggaagauguccaccagggucuc

SEQ ID NO: 2058 - DNA, 21 bp, Artificial Sequence
  Description of Combined DNA/RNA Molecule: Synthetic oligonucleotide
  Description of Artificial Sequence: Synthetic oligonucleotide
gacccugguggacaucuuctt

SEQ ID NO: 2059 - DNA, 21 bp, Artificial Sequence
  Description of Combined DNA/RNA Molecule: Synthetic oligonucleotide
  Description of Artificial Sequence: Synthetic oligonucleotide
gaagauguccaccaggguctt

SEQ ID NO: 2060 - RNA, 21 nt, Artificial Sequence
  Description of Artificial Sequence: Synthetic oligonucleotide
acccugguggacaucuuccag

SEQ ID NO: 2061 - RNA, 23 nt, Artificial Sequence
  Description of Artificial Sequence: Synthetic oligonucleotide
cuggaagauguccaccagggucu

SEQ ID NO: 2062 - DNA, 21 bp, Artificial Sequence
  Description of Combined DNA/RNA Molecule: Synthetic oligonucleotide
  Description of Artificial Sequence: Synthetic oligonucleotide
acccugguggacaucuucctt

SEQ ID NO: 2063 - DNA, 21 bp, Artificial Sequence
  Description of Combined DNA/RNA Molecule: Synthetic oligonucleotide
  Description of Artificial Sequence: Synthetic oligonucleotide
ggaagauguccaccagggutt

SEQ ID NO: 2064 - RNA, 21 nt, Artificial Sequence
  Description of Artificial Sequence: Synthetic oligonucleotide
cccugguggacaucuuccagg

SEQ ID NO: 2065 - RNA, 23 nt, Artificial Sequence
  Description of Artificial Sequence: Synthetic oligonucleotide
ccuggaagauguccaccaggguc

SEQ ID NO: 2066 - DNA, 21 bp, Artificial Sequence
  Description of Combined DNA/RNA Molecule: Synthetic oligonucleotide
  Description of Artificial Sequence: Synthetic oligonucleotide
cccugguggacaucuuccatt

SEQ ID NO: 2067 - DNA, 21 bp, Artificial Sequence
  Description of Combined DNA/RNA Molecule: Synthetic oligonucleotide
  Description of Artificial Sequence: Synthetic oligonucleotide
uggaagauguccaccagggtt

SEQ ID NO: 2068 - RNA, 21 nt, Artificial Sequence
  Description of Artificial Sequence: Synthetic oligonucleotide
ccugguggacaucuuccagga

SEQ ID NO: 2069 - RNA, 23 nt, Artificial Sequence
  Description of Artificial Sequence: Synthetic oligonucleotide
uccuggaagauguccaccagggu

SEQ ID NO: 2070 - DNA, 21 bp, Artificial Sequence
  Description of Combined DNA/RNA Molecule: Synthetic oligonucleotide
  Description of Artificial Sequence: Synthetic oligonucleotide
ccugguggacaucuuccagtt

SEQ ID NO: 2071 - DNA, 21 bp, Artificial Sequence
  Description of Combined DNA/RNA Molecule: Synthetic oligonucleotide
  Description of Artificial Sequence: Synthetic oligonucleotide
cuggaagauguccaccaggtt

SEQ ID NO: 2072 - RNA, 21 nt, Artificial Sequence
  Description of Artificial Sequence: Synthetic oligonucleotide
cugguggacaucuuccaggag

SEQ ID NO: 2073 - RNA, 23 nt, Artificial Sequence
  Description of Artificial Sequence: Synthetic oligonucleotide
cuccuggaagauguccaccaggg

SEQ ID NO: 2074 - DNA, 21 bp, Artificial Sequence
  Description of Combined DNA/RNA Molecule: Synthetic oligonucleotide
  Description of Artificial Sequence: Synthetic oligonucleotide
cugguggacaucuuccaggtt

SEQ ID NO: 2075 - DNA, 21 bp, Artificial Sequence
  Description of Combined DNA/RNA Molecule: Synthetic oligonucleotide
  Description of Artificial Sequence: Synthetic oligonucleotide
ccuggaagauguccaccagtt

SEQ ID NO: 2076 - RNA, 21 nt, Artificial Sequence
  Description of Artificial Sequence: Synthetic oligonucleotide
ugguggacaucuuccaggagu

SEQ ID NO: 2077 - RNA, 23 nt, Artificial Sequence
  Description of Artificial Sequence: Synthetic oligonucleotide
acuccuggaagauguccaccagg

SEQ ID NO: 2078 - DNA, 21 bp, Artificial Sequence
  Description of Combined DNA/RNA Molecule: Synthetic oligonucleotide
  Description of Artificial Sequence: Synthetic oligonucleotide
ugguggacaucuuccaggatt

SEQ ID NO: 2079 - DNA, 21 bp, Artificial Sequence
  Description of Combined DNA/RNA Molecule: Synthetic oligonucleotide
  Description of Artificial Sequence: Synthetic oligonucleotide
uccuggaagauguccaccatt

SEQ ID NO: 2080 - RNA, 21 nt, Artificial Sequence
  Description of Artificial Sequence: Synthetic oligonucleotide
gguggacaucuuccaggagua

SEQ ID NO: 2081 - RNA, 23 nt, Artificial Sequence
  Description of Artificial Sequence: Synthetic oligonucleotide
uacuccuggaagauguccaccag

SEQ ID NO: 2082 - DNA, 21 bp, Artificial Sequence
  Description of Combined DNA/RNA Molecule: Synthetic oligonucleotide
  Description of Artificial Sequence: Synthetic oligonucleotide
gguggacaucuuccaggagtt

SEQ ID NO: 2083 - DNA, 21 bp, Artificial Sequence
  Description of Combined DNA/RNA Molecule: Synthetic oligonucleotide
  Description of Artificial Sequence: Synthetic oligonucleotide
cuccuggaagauguccacctt

SEQ ID NO: 2084 - RNA, 21 nt, Artificial Sequence
  Description of Artificial Sequence: Synthetic oligonucleotide
ggacaucuuccaggaguaccc

SEQ ID NO: 2085 - RNA, 21 nt, Artificial Sequence
  Description of Artificial Sequence: Synthetic oligonucleotide
ggguacuccuggaagaugucc

SEQ ID NO: 2086 - RNA, 21 nt, Artificial Sequence
  Description of Artificial Sequence: Synthetic oligonucleotide
ggacaucuuccaggaguaccc

SEQ ID NO: 2087 - RNA, 21 nt, Artificial Sequence
  Description of Artificial Sequence: Synthetic oligonucleotide
ggguacuccuggaagaugucc

SEQ ID NO: 2088 - DNA, 21 bp, Artificial Sequence
  Description of Combined DNA/RNA Molecule: Synthetic oligonucleotide
  Description of Artificial Sequence: Synthetic oligonucleotide
ggacaucuuccaggaguactt

SEQ ID NO: 2089 - DNA, 21 bp, Artificial Sequence
  Description of Combined DNA/RNA Molecule: Synthetic oligonucleotide
  Description of Artificial Sequence: Synthetic oligonucleotide
guacuccuggaagaugucctt

SEQ ID NO: 2090 - RNA, 19 nt, Artificial Sequence
  Description of Artificial Sequence: Synthetic oligonucleotide
ggacaucuuccaggaguac

SEQ ID NO: 2091 - RNA, 19 nt, Artificial Sequence
  Description of Artificial Sequence: Synthetic oligonucleotide
guacuccuggaagaugucc

SEQ ID NO: 2092 - RNA, 21 nt, Artificial Sequence
  Description of Artificial Sequence: Synthetic oligonucleotide
aucuuccaggaguacccugau

SEQ ID NO: 2093 - RNA, 23 nt, Artificial Sequence
  Description of Artificial Sequence: Synthetic oligonucleotide
aucaggguacuccuggaagaugu

SEQ ID NO: 2094 - DNA, 21 bp, Artificial Sequence
  Description of Combined DNA/RNA Molecule: Synthetic oligonucleotide
  Description of Artificial Sequence: Synthetic oligonucleotide
uacccugaugagaucgagutt

SEQ ID NO: 2095 - DNA, 21 bp, Artificial Sequence
  Description of Combined DNA/RNA Molecule: Synthetic oligonucleotide
  Description of Artificial Sequence: Synthetic oligonucleotide
acucgaucucaucaggguatt

SEQ ID NO: 2096 - RNA, 21 nt, Artificial Sequence
  Description of Artificial Sequence: Synthetic oligonucleotide
acccugaugagaucgaguaca

SEQ ID NO: 2097 - RNA, 23 nt, Artificial Sequence
  Description of Artificial Sequence: Synthetic oligonucleotide
uguacucgaucucaucaggguac

SEQ ID NO: 2098 - DNA, 21 bp, Artificial Sequence
  Description of Combined DNA/RNA Molecule: Synthetic oligonucleotide
  Description of Artificial Sequence: Synthetic oligonucleotide
acccugaugagaucgaguatt

SEQ ID NO: 2099 - DNA, 21 bp, Artificial Sequence
  Description of Combined DNA/RNA Molecule: Synthetic oligonucleotide
  Description of Artificial Sequence: Synthetic oligonucleotide
uacucgaucucaucagggutt

SEQ ID NO: 2100 - DNA, 21 bp, Artificial Sequence
  Description of Combined DNA/RNA Molecule: Synthetic oligonucleotide
  Description of Artificial Sequence: Synthetic oligonucleotide
uacaucuucaagccauccutt

SEQ ID NO: 2101 - DNA, 21 bp, Artificial Sequence
  Description of Combined DNA/RNA Molecule: Synthetic oligonucleotide
  Description of Artificial Sequence: Synthetic oligonucleotide
aggauggcuugaagauguatt

SEQ ID NO: 2102 - RNA, 21 nt, Artificial Sequence
  Description of Artificial Sequence: Synthetic oligonucleotide
aaugacgagggccuggagugu

SEQ ID NO: 2103 - RNA, 23 nt, Artificial Sequence
  Description of Artificial Sequence: Synthetic oligonucleotide
acacuccaggcccucgucauugc

SEQ ID NO: 2104 - RNA, 21 nt, Artificial Sequence
  Description of Artificial Sequence: Synthetic oligonucleotide
gacgagggccuggagugugug

SEQ ID NO: 2105 - RNA, 23 nt, Artificial Sequence
  Description of Artificial Sequence: Synthetic oligonucleotide
cacacacuccaggcccucgucau

SEQ ID NO: 2106 - RNA, 21 nt, Artificial Sequence
  Description of Artificial Sequence: Synthetic oligonucleotide
gugugcccacugaggagucca

SEQ ID NO: 2107 - RNA, 23 nt, Artificial Sequence
  Description of Artificial Sequence: Synthetic oligonucleotide
uggacuccucagugggcacacac

SEQ ID NO: 2108 - RNA, 21 nt, Artificial Sequence
  Description of Artificial Sequence: Synthetic oligonucleotide
gugcccacugaggaguccaac

SEQ ID NO: 2109 - RNA, 23 nt, Artificial Sequence
  Description of Artificial Sequence: Synthetic oligonucleotide
guuggacuccucagugggcacac

SEQ ID NO: 2110 - RNA, 21 nt, Artificial Sequence
  Description of Artificial Sequence: Synthetic oligonucleotide
gcccacugaggaguccaacau

SEQ ID NO: 2111 - RNA, 23 nt, Artificial Sequence
  Description of Artificial Sequence: Synthetic oligonucleotide
auguuggacuccucagugggcac

SEQ ID NO: 2112 - DNA, 21 bp, Artificial Sequence
  Description of Combined DNA/RNA Molecule: Synthetic oligonucleotide
  Description of Artificial Sequence: Synthetic oligonucleotide
ugaggaguccaacaucacctt

SEQ ID NO: 2113 - DNA, 21 bp, Artificial Sequence
  Description of Combined DNA/RNA Molecule: Synthetic oligonucleotide
  Description of Artificial Sequence: Synthetic oligonucleotide
ggugauguuggacuccucatt

SEQ ID NO: 2114 - RNA, 21 nt, Artificial Sequence
  Description of Artificial Sequence: Synthetic oligonucleotide
aucaccaugcagauuaugcgg

SEQ ID NO: 2115 - RNA, 23 nt, Artificial Sequence
  Description of Artificial Sequence: Synthetic oligonucleotide
ccgcauaaucugcauggugaugu

SEQ ID NO: 2116 - DNA, 21 bp, Artificial Sequence
  Description of Combined DNA/RNA Molecule: Synthetic oligonucleotide
  Description of Artificial Sequence: Synthetic oligonucleotide
accaugcagauuaugcggatt

SEQ ID NO: 2117 - DNA, 21 bp, Artificial Sequence
  Description of Combined DNA/RNA Molecule: Synthetic oligonucleotide
  Description of Artificial Sequence: Synthetic oligonucleotide
uccgcauaaucugcauggutt

SEQ ID NO: 2118 - RNA, 21 nt, Artificial Sequence
  Description of Artificial Sequence: Synthetic oligonucleotide
gcagauuaugcggaucaaacc

SEQ ID NO: 2119 - RNA, 23 nt, Artificial Sequence
  Description of Artificial Sequence: Synthetic oligonucleotide
gguuugauccgcauaaucugcau

SEQ ID NO: 2120 - RNA, 21 nt, Artificial Sequence
  Description of Artificial Sequence: Synthetic oligonucleotide
agauuaugcggaucaaaccuc

SEQ ID NO: 2121 - RNA, 23 nt, Artificial Sequence
  Description of Artificial Sequence: Synthetic oligonucleotide
gagguuugauccgcauaaucugc

SEQ ID NO: 2122 - DNA, 21 bp, Artificial Sequence
  Description of Combined DNA/RNA Molecule: Synthetic oligonucleotide
  Description of Artificial Sequence: Synthetic oligonucleotide
uuaugcggaucaaaccucatt

SEQ ID NO: 2123 - DNA, 21 bp, Artificial Sequence
  Description of Combined DNA/RNA Molecule: Synthetic oligonucleotide
  Description of Artificial Sequence: Synthetic oligonucleotide
ugagguuugauccgcauaatt

SEQ ID NO: 2124 - DNA, 21 bp, Artificial Sequence
  Description of Combined DNA/RNA Molecule: Synthetic oligonucleotide
  Description of Artificial Sequence: Synthetic oligonucleotide
uaugcggaucaaaccucactt

SEQ ID NO: 2125 - DNA, 21 bp, Artificial Sequence
  Description of Combined DNA/RNA Molecule: Synthetic oligonucleotide
  Description of Artificial Sequence: Synthetic oligonucleotide
gugagguuugauccgcauatt

SEQ ID NO: 2126 - DNA, 21 bp, Artificial Sequence
  Description of Combined DNA/RNA Molecule: Synthetic oligonucleotide
  Description of Artificial Sequence: Synthetic oligonucleotide
augcggaucaaaccucacctt

SEQ ID NO: 2127 - DNA, 21 bp, Artificial Sequence
  Description of Combined DNA/RNA Molecule: Synthetic oligonucleotide
  Description of Artificial Sequence: Synthetic oligonucleotide
ggugagguuugauccgcautt

SEQ ID NO: 2128 - RNA, 21 nt, Artificial Sequence
  Description of Artificial Sequence: Synthetic oligonucleotide
gcggaucaaaccucaccaagg

SEQ ID NO: 2129 - RNA, 23 nt, Artificial Sequence
  Description of Artificial Sequence: Synthetic oligonucleotide
ccuuggugagguuugauccgcau

SEQ ID NO: 2130 - RNA, 19 nt, Artificial Sequence
  Description of Artificial Sequence: Synthetic oligonucleotide
gcggaucaaaccucaccaa

SEQ ID NO: 2131 - RNA, 19 nt, Artificial Sequence
  Description of Artificial Sequence: Synthetic oligonucleotide
uuggugagguuugauccgc

SEQ ID NO: 2132 - DNA, 21 bp, Artificial Sequence
  Description of Combined DNA/RNA Molecule: Synthetic oligonucleotide
  Description of Artificial Sequence: Synthetic oligonucleotide
gcggaucaaaccucaccaatt

SEQ ID NO: 2133 - DNA, 21 bp, Artificial Sequence
  Description of Combined DNA/RNA Molecule: Synthetic oligonucleotide
  Description of Artificial Sequence: Synthetic oligonucleotide
uuggugagguuugauccgctt

SEQ ID NO: 2134 - RNA, 19 nt, Artificial Sequence
  Description of Artificial Sequence: Synthetic oligonucleotide
gcggaucaaaccucaccaa

SEQ ID NO: 2135 - RNA, 19 nt, Artificial Sequence
  Description of Artificial Sequence: Synthetic oligonucleotide
uuggugagguuugauccgc

SEQ ID NO: 2136 - RNA, 21 nt, Artificial Sequence
  Description of Artificial Sequence: Synthetic oligonucleotide
ggaucaaaccucaccaaggcc

SEQ ID NO: 2137 - RNA, 23 nt, Artificial Sequence
  Description of Artificial Sequence: Synthetic oligonucleotide
ggccuuggugagguuugauccgc

SEQ ID NO: 2138 - RNA, 21 nt, Artificial Sequence
  Description of Artificial Sequence: Synthetic oligonucleotide
cagcacauaggagagaugagc

SEQ ID NO: 2139 - RNA, 23 nt, Artificial Sequence
  Description of Artificial Sequence: Synthetic oligonucleotide
gcucaucucuccuaugugcuggc

SEQ ID NO: 2140 - DNA, 21 bp, Artificial Sequence
  Description of Combined DNA/RNA Molecule: Synthetic oligonucleotide
  Description of Artificial Sequence: Synthetic oligonucleotide
cagcacauaggagagaugatt

SEQ ID NO: 2141 - DNA, 21 bp, Artificial Sequence
  Description of Combined DNA/RNA Molecule: Synthetic oligonucleotide
  Description of Artificial Sequence: Synthetic oligonucleotide
ucaucucuccuaugugcugtt

SEQ ID NO: 2142 - RNA, 21 nt, Artificial Sequence
  Description of Artificial Sequence: Synthetic oligonucleotide
agcacauaggagagaugagcu

SEQ ID NO: 2143 - RNA, 23 nt, Artificial Sequence
  Description of Artificial Sequence: Synthetic oligonucleotide
agcucaucucuccuaugugcugg

SEQ ID NO: 2144 - DNA, 21 bp, Artificial Sequence
  Description of Combined DNA/RNA Molecule: Synthetic oligonucleotide
  Description of Artificial Sequence: Synthetic oligonucleotide
agcacauaggagagaugagtt

SEQ ID NO: 2145 - DNA, 21 bp, Artificial Sequence
  Description of Combined DNA/RNA Molecule: Synthetic oligonucleotide
  Description of Artificial Sequence: Synthetic oligonucleotide
cucaucucuccuaugugcutt

SEQ ID NO: 2146 - RNA, 21 nt, Artificial Sequence
  Description of Artificial Sequence: Synthetic oligonucleotide
gcacauaggagagaugagcuu

SEQ ID NO: 2147 - RNA, 23 nt, Artificial Sequence
  Description of Artificial Sequence: Synthetic oligonucleotide
aagcucaucucuccuaugugcug

SEQ ID NO: 2148 - RNA, 21 nt, Artificial Sequence
  Description of Artificial Sequence: Synthetic oligonucleotide
gcacauaggagagaugagcuu

SEQ ID NO: 2149 - RNA, 21 nt, Artificial Sequence
  Description of Artificial Sequence: Synthetic oligonucleotide
aagcucaucucuccuaugugc

SEQ ID NO: 2150 - DNA, 21 bp, Artificial Sequence
  Description of Combined DNA/RNA Molecule: Synthetic oligonucleotide
  Description of Artificial Sequence: Synthetic oligonucleotide
gcacauaggagagaugagctt

SEQ ID NO: 2151 - DNA, 21 bp, Artificial Sequence
  Description of Combined DNA/RNA Molecule: Synthetic oligonucleotide
  Description of Artificial Sequence: Synthetic oligonucleotide
gcucaucucuccuaugugctt

SEQ ID NO: 2152 - RNA, 19 nt, Artificial Sequence
  Description of Artificial Sequence: Synthetic oligonucleotide
gcacauaggagagaugagc

SEQ ID NO: 2153 - RNA, 19 nt, Artificial Sequence
  Description of Artificial Sequence: Synthetic oligonucleotide
gcucaucucuccuaugugc

SEQ ID NO: 2154 - RNA, 21 nt, Artificial Sequence
  Description of Artificial Sequence: Synthetic oligonucleotide
cacauaggagagaugagcuuc

SEQ ID NO: 2155 - RNA, 23 nt, Artificial Sequence
  Description of Artificial Sequence: Synthetic oligonucleotide
gaagcucaucucuccuaugugcu

SEQ ID NO: 2156 - DNA, 21 bp, Artificial Sequence
  Description of Combined DNA/RNA Molecule: Synthetic oligonucleotide
  Description of Artificial Sequence: Synthetic oligonucleotide
cacauaggagagaugagcutt

SEQ ID NO: 2157 - DNA, 21 bp, Artificial Sequence
  Description of Combined DNA/RNA Molecule: Synthetic oligonucleotide
  Description of Artificial Sequence: Synthetic oligonucleotide
agcucaucucuccuaugugtt

SEQ ID NO: 2158 - RNA, 21 nt, Artificial Sequence
  Description of Artificial Sequence: Synthetic oligonucleotide
cauaggagagaugagcuuccu

SEQ ID NO: 2159 - RNA, 23 nt, Artificial Sequence
  Description of Artificial Sequence: Synthetic oligonucleotide
aggaagcucaucucuccuaugug

SEQ ID NO: 2160 - DNA, 21 bp, Artificial Sequence
  Description of Combined DNA/RNA Molecule: Synthetic oligonucleotide
  Description of Artificial Sequence: Synthetic oligonucleotide
cauaggagagaugagcuuctt

SEQ ID NO: 2161 - DNA, 21 bp, Artificial Sequence
  Description of Combined DNA/RNA Molecule: Synthetic oligonucleotide
  Description of Artificial Sequence: Synthetic oligonucleotide
gaagcucaucucuccuaugtt

SEQ ID NO: 2162 - RNA, 21 nt, Artificial Sequence
  Description of Artificial Sequence: Synthetic oligonucleotide
aggagagaugagcuuccuaca

SEQ ID NO: 2163 - RNA, 23 nt, Artificial Sequence
  Description of Artificial Sequence: Synthetic oligonucleotide
uguaggaagcucaucucuccuau

SEQ ID NO: 2164 - RNA, 21 nt, Artificial Sequence
  Description of Artificial Sequence: Synthetic oligonucleotide
agcacaacaaaugugaaugca

SEQ ID NO: 2165 - RNA, 23 nt, Artificial Sequence
  Description of Artificial Sequence: Synthetic oligonucleotide
ugcauucacauuuguugugcugu

SEQ ID NO: 2166 - RNA, 21 nt, Artificial Sequence
  Description of Artificial Sequence: Synthetic oligonucleotide
acaacaaaugugaaugcagac

SEQ ID NO: 2167 - RNA, 23 nt, Artificial Sequence
  Description of Artificial Sequence: Synthetic oligonucleotide
gucugcauucacauuuguugugc

SEQ ID NO: 2168 - DNA, 21 bp, Artificial Sequence
  Description of Combined DNA/RNA Molecule: Synthetic oligonucleotide
  Description of Artificial Sequence: Synthetic oligonucleotide
augugaaugcagaccaaagtt

SEQ ID NO: 2169 - DNA, 21 bp, Artificial Sequence
  Description of Combined DNA/RNA Molecule: Synthetic oligonucleotide
  Description of Artificial Sequence: Synthetic oligonucleotide
cuuuggucugcauucacautt

SEQ ID NO: 2170 - DNA, 21 bp, Artificial Sequence
  Description of Combined DNA/RNA Molecule: Synthetic oligonucleotide
  Description of Artificial Sequence: Synthetic oligonucleotide
ugugaaugcagaccaaagatt

SEQ ID NO: 2171 - DNA, 21 bp, Artificial Sequence
  Description of Combined DNA/RNA Molecule: Synthetic oligonucleotide
  Description of Artificial Sequence: Synthetic oligonucleotide
ucuuuggucugcauucacatt

SEQ ID NO: 2172 - RNA, 21 nt, Artificial Sequence
  Description of Artificial Sequence: Synthetic oligonucleotide
gugaaugcagaccaaagaaag

SEQ ID NO: 2173 - RNA, 23 nt, Artificial Sequence
  Description of Artificial Sequence: Synthetic oligonucleotide
cuuucuuuggucugcauucacau

SEQ ID NO: 2174 - RNA, 21 nt, Artificial Sequence
  Description of Artificial Sequence: Synthetic oligonucleotide
gugaaugcagaccaaagaaag

SEQ ID NO: 2175 - RNA, 21 nt, Artificial Sequence
  Description of Artificial Sequence: Synthetic oligonucleotide
cuuucuuuggucugcauucac

SEQ ID NO: 2176 - DNA, 21 bp, Artificial Sequence
  Description of Combined DNA/RNA Molecule: Synthetic oligonucleotide
  Description of Artificial Sequence: Synthetic oligonucleotide
gugaaugcagaccaaagaatt

SEQ ID NO: 2177 - DNA, 21 bp, Artificial Sequence
  Description of Combined DNA/RNA Molecule: Synthetic oligonucleotide
  Description of Artificial Sequence: Synthetic oligonucleotide
uucuuuggucugcauucactt

SEQ ID NO: 2178 - RNA, 19 nt, Artificial Sequence
  Description of Artificial Sequence: Synthetic oligonucleotide
gugaaugcagaccaaagaa

SEQ ID NO: 2179 - RNA, 19 nt, Artificial Sequence
  Description of Artificial Sequence: Synthetic oligonucleotide
uucuuuggucugcauucac

SEQ ID NO: 2180 - RNA, 21 nt, Artificial Sequence
  Description of Artificial Sequence: Synthetic oligonucleotide
gaaugcagaccaaagaaagau

SEQ ID NO: 2181 - RNA, 23 nt, Artificial Sequence
  Description of Artificial Sequence: Synthetic oligonucleotide
aucuuucuuuggucugcauucac

SEQ ID NO: 2182 - DNA, 21 bp, Artificial Sequence
  Description of Combined DNA/RNA Molecule: Synthetic oligonucleotide
  Description of Artificial Sequence: Synthetic oligonucleotide
gaaugcagaccaaagaaagtt

SEQ ID NO: 2183 - DNA, 21 bp, Artificial Sequence
  Description of Combined DNA/RNA Molecule: Synthetic oligonucleotide
  Description of Artificial Sequence: Synthetic oligonucleotide
cuuucuuuggucugcauuctt

SEQ ID NO: 2184 - RNA, 23 nt, Homo sapiens
augaacuuucugcugucuugggu

SEQ ID NO: 2185 - RNA, 23 nt, Homo sapiens
gugcauuggagccuugccuugcu

SEQ ID NO: 2186 - RNA, 23 nt, Homo sapiens
ucuaccuccaccaugccaagugg

SEQ ID NO: 2187 - RNA, 23 nt, Homo sapiens
cuaccuccaccaugccaaguggu

SEQ ID NO: 2188 - RNA, 23 nt, Homo sapiens
accuccaccaugccaaguggucc

SEQ ID NO: 2189 - RNA, 23 nt, Homo sapiens
ccuccaccaugccaagugguccc

SEQ ID NO: 2190 - RNA, 23 nt, Homo sapiens
cuccaccaugccaagugguccca

SEQ ID NO: 2191 - RNA, 23 nt, Homo sapiens
uccaccaugccaaguggucccag

SEQ ID NO: 2192 - RNA, 23 nt, Homo sapiens
ccaccaugccaaguggucccagg

SEQ ID NO: 2193 - RNA, 23 nt, Homo sapiens
caccaugccaaguggucccaggc

SEQ ID NO: 2194 - RNA, 23 nt, Homo sapiens
accaugccaaguggucccaggcu

SEQ ID NO: 2195 - RNA, 23 nt, Homo sapiens
ccaugccaaguggucccaggcug

SEQ ID NO: 2196 - RNA, 23 nt, Homo sapiens
caugccaaguggucccaggcugc

SEQ ID NO: 2197 - RNA, 23 nt, Homo sapiens
augccaaguggucccaggcugca

SEQ ID NO: 2198 - RNA, 23 nt, Homo sapiens
ugccaaguggucccaggcugcac

SEQ ID NO: 2199 - RNA, 23 nt, Homo sapiens
gccaaguggucccaggcugcacc

SEQ ID NO: 2200 - RNA, 23 nt, Homo sapiens
ccaaguggucccaggcugcaccc

SEQ ID NO: 2201 - RNA, 23 nt, Homo sapiens
caaguggucccaggcugcaccca

SEQ ID NO: 2202 - RNA, 23 nt, Homo sapiens
aaguggucccaggcugcacccau

SEQ ID NO: 2203 - RNA, 23 nt, Homo sapiens
agggcagaaucaucacgaagugg

SEQ ID NO: 2204 - RNA, 23 nt, Homo sapiens
gggcagaaucaucacgaaguggu

SEQ ID NO: 2205 - RNA, 23 nt, Homo sapiens
ggcagaaucaucacgaaguggug

SEQ ID NO: 2206 - RNA, 23 nt, Homo sapiens
gcagaaucaucacgaagugguga

SEQ ID NO: 2207 - RNA, 23 nt, Homo sapiens
cagaaucaucacgaaguggugaa

SEQ ID NO: 2208 - RNA, 23 nt, Homo sapiens
agaaucaucacgaaguggugaag

SEQ ID NO: 2209 - RNA, 23 nt, Homo sapiens
gaaucaucacgaaguggugaagu

SEQ ID NO: 2210 - RNA, 23 nt, Homo sapiens
acgaaguggugaaguucauggau

SEQ ID NO: 2211 - RNA, 23 nt, Homo sapiens
gugaaguucauggaugucuauca

SEQ ID NO: 2212 - RNA, 23 nt, Homo sapiens
cauggaugucuaucagcgcagcu

SEQ ID NO: 2213 - RNA, 23 nt, Homo sapiens
auggaugucuaucagcgcagcua

SEQ ID NO: 2214 - RNA, 23 nt, Homo sapiens
uggaugucuaucagcgcagcuac

SEQ ID NO: 2215 - RNA, 23 nt, Homo sapiens
ggaugucuaucagcgcagcuacu

SEQ ID NO: 2216 - RNA, 23 nt, Homo sapiens
gaugucuaucagcgcagcuacug

SEQ ID NO: 2217 - RNA, 23 nt, Homo sapiens
augucuaucagcgcagcuacugc

SEQ ID NO: 2218 - RNA, 23 nt, Homo sapiens
ugucuaucagcgcagcuacugcc

SEQ ID NO: 2219 - RNA, 23 nt, Homo sapiens
gcgcagcuacugccauccaaucg

SEQ ID NO: 2220 - RNA, 23 nt, Homo sapiens
gcagcuacugccauccaaucgag

SEQ ID NO: 2221 - RNA, 23 nt, Homo sapiens
gcuacugccauccaaucgagacc

SEQ ID NO: 2222 - RNA, 23 nt, Homo sapiens
cuacugccauccaaucgagaccc

SEQ ID NO: 2223 - RNA, 23 nt, Homo sapiens
uacugccauccaaucgagacccu

SEQ ID NO: 2224 - RNA, 23 nt, Homo sapiens
acugccauccaaucgagacccug

SEQ ID NO: 2225 - RNA, 23 nt, Homo sapiens
gagacccugguggacaucuucca

SEQ ID NO: 2226 - RNA, 23 nt, Homo sapiens
agacccugguggacaucuuccag

SEQ ID NO: 2227 - RNA, 23 nt, Homo sapiens
gacccugguggacaucuuccagg

SEQ ID NO: 2228 - RNA, 23 nt, Homo sapiens
acccugguggacaucuuccagga

SEQ ID NO: 2229 - RNA, 23 nt, Homo sapiens
cccugguggacaucuuccaggag

SEQ ID NO: 2230 - RNA, 23 nt, Homo sapiens
ccugguggacaucuuccaggagu

SEQ ID NO: 2231 - RNA, 23 nt, Homo sapiens
cugguggacaucuuccaggagua

SEQ ID NO: 2232 - RNA, 23 nt, Homo sapiens
guggacaucuuccaggaguaccc

SEQ ID NO: 2233 - RNA, 23 nt, Homo sapiens
acaucuuccaggaguacccugau

SEQ ID NO: 2234 - RNA, 23 nt, Homo sapiens
aguacccugaugagaucgaguac

SEQ ID NO: 2235 - RNA, 23 nt, Homo sapiens
guacccugaugagaucgaguaca

SEQ ID NO: 2236 - RNA, 23 nt, Homo sapiens
aguacaucuucaagccauccugu

SEQ ID NO: 2237 - RNA, 23 nt, Homo sapiens
gcaaugacgagggccuggagugu

SEQ ID NO: 2238 - RNA, 23 nt, Homo sapiens
augacgagggccuggagugugug

SEQ ID NO: 2239 - RNA, 23 nt, Homo sapiens
gugugugcccacugaggagucca

SEQ ID NO: 2240 - RNA, 23 nt, Homo sapiens
gugugcccacugaggaguccaac

SEQ ID NO: 2241 - RNA, 23 nt, Homo sapiens
gugcccacugaggaguccaacau

SEQ ID NO: 2242 - RNA, 23 nt, Homo sapiens
acugaggaguccaacaucaccau

SEQ ID NO: 2243 - RNA, 23 nt, Homo sapiens
acaucaccaugcagauuaugcgg

SEQ ID NO: 2244 - RNA, 23 nt, Homo sapiens
ucaccaugcagauuaugcggauc

SEQ ID NO: 2245 - RNA, 23 nt, Homo sapiens
augcagauuaugcggaucaaacc

SEQ ID NO: 2246 - RNA, 23 nt, Homo sapiens
gcagauuaugcggaucaaaccuc

SEQ ID NO: 2247 - RNA, 23 nt, Homo sapiens
gauuaugcggaucaaaccucacc

SEQ ID NO: 2248 - RNA, 23 nt, Homo sapiens
auuaugcggaucaaaccucacca

SEQ ID NO: 2249 - RNA, 23 nt, Homo sapiens
uuaugcggaucaaaccucaccaa

SEQ ID NO: 2250 - RNA, 23 nt, Homo sapiens
augcggaucaaaccucaccaagg

SEQ ID NO: 2251 - RNA, 23 nt, Homo sapiens
gcggaucaaaccucaccaaggcc

SEQ ID NO: 2252 - RNA, 23 nt, Homo sapiens
gccagcacauaggagagaugagc

SEQ ID NO: 2253 - RNA, 23 nt, Homo sapiens
ccagcacauaggagagaugagcu

SEQ ID NO: 2254 - RNA, 23 nt, Homo sapiens
cagcacauaggagagaugagcuu

SEQ ID NO: 2255 - RNA, 23 nt, Homo sapiens
agcacauaggagagaugagcuuc

SEQ ID NO: 2256 - RNA, 23 nt, Homo sapiens
cacauaggagagaugagcuuccu

SEQ ID NO: 2257 - RNA, 23 nt, Homo sapiens
auaggagagaugagcuuccuaca

SEQ ID NO: 2258 - RNA, 23 nt, Homo sapiens
acagcacaacaaaugugaaugca

SEQ ID NO: 2259 - RNA, 23 nt, Homo sapiens
gcacaacaaaugugaaugcagac

SEQ ID NO: 2260 - RNA, 23 nt, Homo sapiens
aaaugugaaugcagaccaaagaa

SEQ ID NO: 2261 - RNA, 23 nt, Homo sapiens
aaugugaaugcagaccaaagaaa

SEQ ID NO: 2262 - RNA, 23 nt, Homo sapiens
augugaaugcagaccaaagaaag

SEQ ID NO: 2263 - RNA, 23 nt, Homo sapiens
gugaaugcagaccaaagaaagau

SEQ ID NO: 2264 - RNA, 19 nt, Homo sapiens
accaaggccagcacauagg

SEQ ID NO: 2265 - RNA, 19 nt, Homo sapiens
ccaaggccagcacauagga

SEQ ID NO: 2266 - RNA, 19 nt, Homo sapiens
ccaaggccagcacauagga

SEQ ID NO: 2267 - RNA, 19 nt, Homo sapiens
aaggccagcacauaggaga

SEQ ID NO: 2268 - RNA, 19 nt, Homo sapiens
aggccagcacauaggagag

SEQ ID NO: 2269 - RNA, 19 nt, Homo sapiens
ggccagcacauaggagaga

SEQ ID NO: 2270 - RNA, 19 nt, Homo sapiens
gccagcacauaggagagau

SEQ ID NO: 2271 - RNA, 19 nt, Homo sapiens
ccagcacauaggagagaug

SEQ ID NO: 2272 - RNA, 19 nt, Homo sapiens
cagcacauaggagagauga

SEQ ID NO: 2273 - RNA, 19 nt, Homo sapiens
agcacauaggagagaugag

SEQ ID NO: 2274 - RNA, 19 nt, Homo sapiens
cacauaggagagaugagcu

SEQ ID NO: 2275 - RNA, 19 nt, Homo sapiens
acauaggagagaugagcuu

SEQ ID NO: 2276 - RNA, 19 nt, Homo sapiens
cauaggagagaugagcuuc

SEQ ID NO: 2277 - RNA, 19 nt, Homo sapiens
auaggagagaugagcuucc

SEQ ID NO: 2278 - RNA, 19 nt, Homo sapiens
uaggagagaugagcuuccu

SEQ ID NO: 2279 - RNA, 19 nt, Homo sapiens
aggagagaugagcuuccua

SEQ ID NO: 2280 - RNA, 19 nt, Homo sapiens
ggagagaugagcuuccuac

SEQ ID NO: 2281 - RNA, 19 nt, Homo sapiens
gagagaugagcuuccuaca

SEQ ID NO: 2282 - RNA, 19 nt, Homo sapiens
agagaugagcuuccuacag

SEQ ID NO: 2283 - RNA, 19 nt, Homo sapiens
gagaugagcuuccuacagc

SEQ ID NO: 2284 - RNA, 19 nt, Homo sapiens
auguuccuuaucgagaauc

SEQ ID NO: 2285 - RNA, 19 nt, Homo sapiens
uguuccuuaucgagaaucu

SEQ ID NO: 2286 - RNA, 19 nt, Homo sapiens
guuccuuaucgagaaucua

SEQ ID NO: 2287 - RNA, 19 nt, Homo sapiens
uuccuuaucgagaaucuaa

SEQ ID NO: 2288 - RNA, 19 nt, Homo sapiens
uccuuaucgagaaucuaaa

SEQ ID NO: 2289 - RNA, 19 nt, Homo sapiens
ccuuaucgagaaucuaaac

SEQ ID NO: 2290 - RNA, 19 nt, Homo sapiens
cuuaucgagaaucuaaacu

SEQ ID NO: 2291 - RNA, 19 nt, Homo sapiens
uuaucgagaaucuaaacua

SEQ ID NO: 2292 - RNA, 19 nt, Homo sapiens
uaucgagaaucuaaacuaa

SEQ ID NO: 2293 - RNA, 19 nt, Homo sapiens
aucgagaaucuaaacuaac

SEQ ID NO: 2294 - RNA, 19 nt, Homo sapiens
cgagaaucuaaacuaacua

SEQ ID NO: 2295 - RNA, 19 nt, Homo sapiens
gagaaucuaaacuaacuag

SEQ ID NO: 2296 - RNA, 19 nt, Homo sapiens
agaaucuaaacuaacuaga

SEQ ID NO: 2297 - RNA, 19 nt, Homo sapiens
gaaucuaaacuaacuagaa

SEQ ID NO: 2298 - RNA, 19 nt, Homo sapiens
aaucuaaacuaacuagaau

SEQ ID NO: 2299 - RNA, 19 nt, Homo sapiens
aucuaaacuaacuagaauc

SEQ ID NO: 2300 - RNA, 19 nt, Homo sapiens
ucuaaacuaacuagaaucc

SEQ ID NO: 2301 - RNA, 19 nt, Homo sapiens
cuaaacuaacuagaauccu

SEQ ID NO: 2302 - RNA, 19 nt, Homo sapiens
uaaacuaacuagaauccuc

SEQ ID NO: 2303 - RNA, 19 nt, Homo sapiens
aaacuaacuagaauccucc

SEQ ID NO: 2304 - DNA, 21 bp, Artificial Sequence
  Description of Combined DNA/RNA Molecule: Synthetic oligonucleotide
  Description of Artificial Sequence: Synthetic oligonucleotide
accaaggccagcacauaggtt

SEQ ID NO: 2305 - DNA, 21 bp, Artificial Sequence
  Description of Combined DNA/RNA Molecule: Synthetic oligonucleotide
  Description of Artificial Sequence: Synthetic oligonucleotide
ccuaugugcuggccuuggutt

SEQ ID NO: 2306 - DNA, 21 bp, Artificial Sequence
  Description of Combined DNA/RNA Molecule: Synthetic oligonucleotide
  Description of Artificial Sequence: Synthetic oligonucleotide
ccaaggccagcacauaggatt

SEQ ID NO: 2307 - DNA, 21 bp, Artificial Sequence
  Description of Combined DNA/RNA Molecule: Synthetic oligonucleotide
  Description of Artificial Sequence: Synthetic oligonucleotide
uccuaugugcuggccuuggtt

SEQ ID NO: 2308 - DNA, 21 bp, Artificial Sequence
  Description of Combined DNA/RNA Molecule: Synthetic oligonucleotide
  Description of Artificial Sequence: Synthetic oligonucleotide
ccaaggccagcacauaggatt

SEQ ID NO: 2309 - DNA, 21 bp, Artificial Sequence
  Description of Combined DNA/RNA Molecule: Synthetic oligonucleotide
  Description of Artificial Sequence: Synthetic oligonucleotide
cuccuaugugcuggccuugtt

SEQ ID NO: 2310 - DNA, 21 bp, Artificial Sequence
  Description of Combined DNA/RNA Molecule: Synthetic oligonucleotide
  Description of Artificial Sequence: Synthetic oligonucleotide
aaggccagcacauaggagatt

SEQ ID NO: 2311 - DNA, 21 bp, Artificial Sequence
  Description of Combined DNA/RNA Molecule: Synthetic oligonucleotide
  Description of Artificial Sequence: Synthetic oligonucleotide
ucuccuaugugcuggccuutt

SEQ ID NO: 2312 - DNA, 21 bp, Artificial Sequence
  Description of Combined DNA/RNA Molecule: Synthetic oligonucleotide
  Description of Artificial Sequence: Synthetic oligonucleotide
aggccagcacauaggagagtt

SEQ ID NO: 2313 - DNA, 21 bp, Artificial Sequence
  Description of Combined DNA/RNA Molecule: Synthetic oligonucleotide
  Description of Artificial Sequence: Synthetic oligonucleotide
cucuccuaugugcuggccutt

SEQ ID NO: 2314 - DNA, 21 bp, Artificial Sequence
  Description of Combined DNA/RNA Molecule: Synthetic oligonucleotide
  Description of Artificial Sequence: Synthetic oligonucleotide
ggccagcacauaggagagatt

SEQ ID NO: 2315 - DNA, 21 bp, Artificial Sequence
  Description of Combined DNA/RNA Molecule: Synthetic oligonucleotide
  Description of Artificial Sequence: Synthetic oligonucleotide
ucucuccuaugugcuggcctt

SEQ ID NO: 2316 - DNA, 21 bp, Artificial Sequence
  Description of Combined DNA/RNA Molecule: Synthetic oligonucleotide
  Description of Artificial Sequence: Synthetic oligonucleotide
gccagcacauaggagagautt

SEQ ID NO: 2317 - DNA, 21 bp, Artificial Sequence
  Description of Combined DNA/RNA Molecule: Synthetic oligonucleotide
  Description of Artificial Sequence: Synthetic oligonucleotide
aucucuccuaugugcuggctt

SEQ ID NO: 2318 - DNA, 21 bp, Artificial Sequence
  Description of Combined DNA/RNA Molecule: Synthetic oligonucleotide
  Description of Artificial Sequence: Synthetic oligonucleotide
ccagcacauaggagagaugtt

SEQ ID NO: 2319 - DNA, 21 bp, Artificial Sequence
  Description of Combined DNA/RNA Molecule: Synthetic oligonucleotide
  Description of Artificial Sequence: Synthetic oligonucleotide
caucucuccuaugugcuggtt

SEQ ID NO: 2320 - DNA, 21 bp, Artificial Sequence
  Description of Combined DNA/RNA Molecule: Synthetic oligonucleotide
  Description of Artificial Sequence: Synthetic oligonucleotide
cagcacauaggagagaugatt

SEQ ID NO: 2321 - DNA, 21 bp, Artificial Sequence
  Description of Combined DNA/RNA Molecule: Synthetic oligonucleotide
  Description of Artificial Sequence: Synthetic oligonucleotide
ucaucucuccuaugugcugtt

SEQ ID NO: 2322 - DNA, 21 bp, Artificial Sequence
  Description of Combined DNA/RNA Molecule: Synthetic oligonucleotide
  Description of Artificial Sequence: Synthetic oligonucleotide
agcacauaggagagaugagtt

SEQ ID NO: 2323 - DNA, 21 bp, Artificial Sequence
  Description of Combined DNA/RNA Molecule: Synthetic oligonucleotide
  Description of Artificial Sequence: Synthetic oligonucleotide
cucaucucuccuaugugcutt

SEQ ID NO: 2324 - DNA, 21 bp, Artificial Sequence
  Description of Combined DNA/RNA Molecule: Synthetic oligonucleotide
  Description of Artificial Sequence: Synthetic oligonucleotide
cacauaggagagaugagcutt

SEQ ID NO: 2325 - DNA, 21 bp, Artificial Sequence
  Description of Combined DNA/RNA Molecule: Synthetic oligonucleotide
  Description of Artificial Sequence: Synthetic oligonucleotide
agcucaucucuccuaugugtt

SEQ ID NO: 2326 - DNA, 21 bp, Artificial Sequence
  Description of Combined DNA/RNA Molecule: Synthetic oligonucleotide
  Description of Artificial Sequence: Synthetic oligonucleotide
acauaggagagaugagcuutt

SEQ ID NO: 2327 - DNA, 21 bp, Artificial Sequence
  Description of Combined DNA/RNA Molecule: Synthetic oligonucleotide
  Description of Artificial Sequence: Synthetic oligonucleotide
aagcucaucucuccuaugutt

SEQ ID NO: 2328 - DNA, 21 bp, Artificial Sequence
  Description of Combined DNA/RNA Molecule: Synthetic oligonucleotide
  Description of Artificial Sequence: Synthetic oligonucleotide
cauaggagagaugagcuuctt

SEQ ID NO: 2329 - DNA, 21 bp, Artificial Sequence
  Description of Combined DNA/RNA Molecule: Synthetic oligonucleotide
  Description of Artificial Sequence: Synthetic oligonucleotide
gaagcucaucucuccuaugtt

SEQ ID NO: 2330 - DNA, 21 bp, Artificial Sequence
  Description of Combined DNA/RNA Molecule: Synthetic oligonucleotide
  Description of Artificial Sequence: Synthetic oligonucleotide
auaggagagaugagcuucctt

SEQ ID NO: 2331 - DNA, 21 bp, Artificial Sequence
  Description of Combined DNA/RNA Molecule: Synthetic oligonucleotide
  Description of Artificial Sequence: Synthetic oligonucleotide
ggaagcucaucucuccuautt

SEQ ID NO: 2332 - DNA, 21 bp, Artificial Sequence
  Description of Combined DNA/RNA Molecule: Synthetic oligonucleotide
  Description of Artificial Sequence: Synthetic oligonucleotide
uaggagagaugagcuuccutt

SEQ ID NO: 2333 - DNA, 21 bp, Artificial Sequence
  Description of Combined DNA/RNA Molecule: Synthetic oligonucleotide
  Description of Artificial Sequence: Synthetic oligonucleotide
aggaagcucaucucuccuatt

SEQ ID NO: 2334 - DNA, 21 bp, Artificial Sequence
  Description of Combined DNA/RNA Molecule: Synthetic oligonucleotide
  Description of Artificial Sequence: Synthetic oligonucleotide
aggagagaugagcuuccuatt

SEQ ID NO: 2335 - DNA, 21 bp, Artificial Sequence
  Description of Combined DNA/RNA Molecule: Synthetic oligonucleotide
  Description of Artificial Sequence: Synthetic oligonucleotide
uaggaagcucaucucuccutt

SEQ ID NO: 2336 - DNA, 21 bp, Artificial Sequence
  Description of Combined DNA/RNA Molecule: Synthetic oligonucleotide
  Description of Artificial Sequence: Synthetic oligonucleotide
ggagagaugagcuuccuactt

SEQ ID NO: 2337 - DNA, 21 bp, Artificial Sequence
  Description of Combined DNA/RNA Molecule: Synthetic oligonucleotide
  Description of Artificial Sequence: Synthetic oligonucleotide
guaggaagcucaucucucctt

SEQ ID NO: 2338 - DNA, 21 bp, Artificial Sequence
  Description of Combined DNA/RNA Molecule: Synthetic oligonucleotide
  Description of Artificial Sequence: Synthetic oligonucleotide
gagagaugagcuuccuacatt

SEQ ID NO: 2339 - DNA, 21 bp, Artificial Sequence
  Description of Combined DNA/RNA Molecule: Synthetic oligonucleotide
  Description of Artificial Sequence: Synthetic oligonucleotide
uguaggaagcucaucucuctt

SEQ ID NO: 2340 - DNA, 21 bp, Artificial Sequence
  Description of Combined DNA/RNA Molecule: Synthetic oligonucleotide
  Description of Artificial Sequence: Synthetic oligonucleotide
agagaugagcuuccuacagtt

SEQ ID NO: 2341 - DNA, 21 bp, Artificial Sequence
  Description of Combined DNA/RNA Molecule: Synthetic oligonucleotide
  Description of Artificial Sequence: Synthetic oligonucleotide
cuguaggaagcucaucucutt

SEQ ID NO: 2342 - DNA, 21 bp, Artificial Sequence
  Description of Combined DNA/RNA Molecule: Synthetic oligonucleotide
  Description of Artificial Sequence: Synthetic oligonucleotide
gagaugagcuuccuacagctt

SEQ ID NO: 2343 - DNA, 21 bp, Artificial Sequence
  Description of Combined DNA/RNA Molecule: Synthetic oligonucleotide
  Description of Artificial Sequence: Synthetic oligonucleotide
gcuguaggaagcucaucuctt

SEQ ID NO: 2344 - DNA, 21 bp, Artificial Sequence
  Description of Combined DNA/RNA Molecule: Synthetic oligonucleotide
  Description of Artificial Sequence: Synthetic oligonucleotide
auguuccuuaucgagaauctt

SEQ ID NO: 2345 - DNA, 21 bp, Artificial Sequence
  Description of Combined DNA/RNA Molecule: Synthetic oligonucleotide
  Description of Artificial Sequence: Synthetic oligonucleotide
gauucucgauaaggaacautt

SEQ ID NO: 2346 - DNA, 21 bp, Artificial Sequence
  Description of Combined DNA/RNA Molecule: Synthetic oligonucleotide
  Description of Artificial Sequence: Synthetic oligonucleotide
uguuccuuaucgagaaucutt

SEQ ID NO: 2347 - DNA, 21 bp, Artificial Sequence
  Description of Combined DNA/RNA Molecule: Synthetic oligonucleotide
  Description of Artificial Sequence: Synthetic oligonucleotide
agauucucgauaaggaacatt

SEQ ID NO: 2348 - DNA, 21 bp, Artificial Sequence
  Description of Combined DNA/RNA Molecule: Synthetic oligonucleotide
  Description of Artificial Sequence: Synthetic oligonucleotide
guuccuuaucgagaaucuatt

SEQ ID NO: 2349 - DNA, 21 bp, Artificial Sequence
  Description of Combined DNA/RNA Molecule: Synthetic oligonucleotide
  Description of Artificial Sequence: Synthetic oligonucleotide
uagauucucgauaaggaactt

SEQ ID NO: 2350 - DNA, 21 bp, Artificial Sequence
  Description of Combined DNA/RNA Molecule: Synthetic oligonucleotide
  Description of Artificial Sequence: Synthetic oligonucleotide
uuccuuaucgagaaucuaatt

SEQ ID NO: 2351 - DNA, 21 bp, Artificial Sequence
  Description of Combined DNA/RNA Molecule: Synthetic oligonucleotide
  Description of Artificial Sequence: Synthetic oligonucleotide
uuagauucucgauaaggaatt

SEQ ID NO: 2352 - DNA, 21 bp, Artificial Sequence
  Description of Combined DNA/RNA Molecule: Synthetic oligonucleotide
  Description of Artificial Sequence: Synthetic oligonucleotide
uccuuaucgagaaucuaaatt

SEQ ID NO: 2353 - DNA, 21 bp, Artificial Sequence
  Description of Combined DNA/RNA Molecule: Synthetic oligonucleotide
  Description of Artificial Sequence: Synthetic oligonucleotide
uuuagauucucgauaaggatt

SEQ ID NO: 2354 - DNA, 21 bp, Artificial Sequence
  Description of Combined DNA/RNA Molecule: Synthetic oligonucleotide
  Description of Artificial Sequence: Synthetic oligonucleotide
ccuuaucgagaaucuaaactt

SEQ ID NO: 2355 - DNA, 21 bp, Artificial Sequence
  Description of Combined DNA/RNA Molecule: Synthetic oligonucleotide
  Description of Artificial Sequence: Synthetic oligonucleotide
guuuagauucucgauaaggtt

SEQ ID NO: 2356 - DNA, 21 bp, Artificial Sequence
  Description of Combined DNA/RNA Molecule: Synthetic oligonucleotide
  Description of Artificial Sequence: Synthetic oligonucleotide
cuuaucgagaaucuaaacutt

SEQ ID NO: 2357 - DNA, 21 bp, Artificial Sequence
  Description of Combined DNA/RNA Molecule: Synthetic oligonucleotide
  Description of Artificial Sequence: Synthetic oligonucleotide
aguuuagauucucgauaagtt

SEQ ID NO: 2358 - DNA, 21 bp, Artificial Sequence
  Description of Combined DNA/RNA Molecule: Synthetic oligonucleotide
  Description of Artificial Sequence: Synthetic oligonucleotide
uuaucgagaaucuaaacuatt

SEQ ID NO: 2359 - DNA, 21 bp, Artificial Sequence
  Description of Combined DNA/RNA Molecule: Synthetic oligonucleotide
  Description of Artificial Sequence: Synthetic oligonucleotide
uaguuuagauucucgauaatt

SEQ ID NO: 2360 - DNA, 21 bp, Artificial Sequence
  Description of Combined DNA/RNA Molecule: Synthetic oligonucleotide
  Description of Artificial Sequence: Synthetic oligonucleotide
uaucgagaaucuaaacuaatt

SEQ ID NO: 2361 - DNA, 21 bp, Artificial Sequence
  Description of Combined DNA/RNA Molecule: Synthetic oligonucleotide
  Description of Artificial Sequence: Synthetic oligonucleotide
uuaguuuagauucucgauatt

SEQ ID NO: 2362 - DNA, 21 bp, Artificial Sequence
  Description of Combined DNA/RNA Molecule: Synthetic oligonucleotide
  Description of Artificial Sequence: Synthetic oligonucleotide
aucgagaaucuaaacuaactt

SEQ ID NO: 2363 - DNA, 21 bp, Artificial Sequence
  Description of Combined DNA/RNA Molecule: Synthetic oligonucleotide
  Description of Artificial Sequence: Synthetic oligonucleotide
guuaguuuagauucucgautt

SEQ ID NO: 2364 - DNA, 21 bp, Artificial Sequence
  Description of Combined DNA/RNA Molecule: Synthetic oligonucleotide
  Description of Artificial Sequence: Synthetic oligonucleotide
cgagaaucuaaacuaacuatt

SEQ ID NO: 2365 - DNA, 21 bp, Artificial Sequence
  Description of Combined DNA/RNA Molecule: Synthetic oligonucleotide
  Description of Artificial Sequence: Synthetic oligonucleotide
uaguuaguuuagauucucgtt

SEQ ID NO: 2366 - DNA, 21 bp, Artificial Sequence
  Description of Combined DNA/RNA Molecule: Synthetic oligonucleotide
  Description of Artificial Sequence: Synthetic oligonucleotide
gagaaucuaaacuaacuagtt

SEQ ID NO: 2367 - DNA, 21 bp, Artificial Sequence
  Description of Combined DNA/RNA Molecule: Synthetic oligonucleotide
  Description of Artificial Sequence: Synthetic oligonucleotide
cuaguuaguuuagauucuctt

SEQ ID NO: 2368 - DNA, 21 bp, Artificial Sequence
  Description of Combined DNA/RNA Molecule: Synthetic oligonucleotide
  Description of Artificial Sequence: Synthetic oligonucleotide
agaaucuaaacuaacuagatt

SEQ ID NO: 2369 - DNA, 21 bp, Artificial Sequence
  Description of Combined DNA/RNA Molecule: Synthetic oligonucleotide
  Description of Artificial Sequence: Synthetic oligonucleotide
ucuaguuaguuuagauucutt

SEQ ID NO: 2370 - DNA, 21 bp, Artificial Sequence
  Description of Combined DNA/RNA Molecule: Synthetic oligonucleotide
  Description of Artificial Sequence: Synthetic oligonucleotide
gaaucuaaacuaacuagaatt

SEQ ID NO: 2371 - DNA, 21 bp, Artificial Sequence
  Description of Combined DNA/RNA Molecule: Synthetic oligonucleotide
  Description of Artificial Sequence: Synthetic oligonucleotide
uucuaguuaguuuagauuctt

SEQ ID NO: 2372 - DNA, 21 bp, Artificial Sequence
  Description of Combined DNA/RNA Molecule: Synthetic oligonucleotide
  Description of Artificial Sequence: Synthetic oligonucleotide
aaucuaaacuaacuagaautt

SEQ ID NO: 2373 - DNA, 21 bp, Artificial Sequence
  Description of Combined DNA/RNA Molecule: Synthetic oligonucleotide
  Description of Artificial Sequence: Synthetic oligonucleotide
auucuaguuaguuuagauutt

SEQ ID NO: 2374 - DNA, 21 bp, Artificial Sequence
  Description of Combined DNA/RNA Molecule: Synthetic oligonucleotide
  Description of Artificial Sequence: Synthetic oligonucleotide
aucuaaacuaacuagaauctt

SEQ ID NO: 2375 - DNA, 21 bp, Artificial Sequence
  Description of Combined DNA/RNA Molecule: Synthetic oligonucleotide
  Description of Artificial Sequence: Synthetic oligonucleotide
gauucuaguuaguuuagautt

SEQ ID NO: 2376 - DNA, 21 bp, Artificial Sequence
  Description of Combined DNA/RNA Molecule: Synthetic oligonucleotide
  Description of Artificial Sequence: Synthetic oligonucleotide
ucuaaacuaacuagaaucctt

SEQ ID NO: 2377 - DNA, 21 bp, Artificial Sequence
  Description of Combined DNA/RNA Molecule: Synthetic oligonucleotide
  Description of Artificial Sequence: Synthetic oligonucleotide
ggauucuaguuaguuuagatt

SEQ ID NO: 2378 - DNA, 21 bp, Artificial Sequence
  Description of Combined DNA/RNA Molecule: Synthetic oligonucleotide
  Description of Artificial Sequence: Synthetic oligonucleotide
cuaaacuaacuagaauccutt

SEQ ID NO: 2379 - DNA, 21 bp, Artificial Sequence
  Description of Combined DNA/RNA Molecule: Synthetic oligonucleotide
  Description of Artificial Sequence: Synthetic oligonucleotide
aggauucuaguuaguuuagtt

SEQ ID NO: 2380 - DNA, 21 bp, Artificial Sequence
  Description of Combined DNA/RNA Molecule: Synthetic oligonucleotide
  Description of Artificial Sequence: Synthetic oligonucleotide
uaaacuaacuagaauccuctt

SEQ ID NO: 2381 - DNA, 21 bp, Artificial Sequence
  Description of Combined DNA/RNA Molecule: Synthetic oligonucleotide
  Description of Artificial Sequence: Synthetic oligonucleotide
gaggauucuaguuaguuuatt

SEQ ID NO: 2382 - DNA, 21 bp, Artificial Sequence
  Description of Combined DNA/RNA Molecule: Synthetic oligonucleotide
  Description of Artificial Sequence: Synthetic oligonucleotide
aaacuaacuagaauccucctt

SEQ ID NO: 2383 - DNA, 21 bp, Artificial Sequence
  Description of Combined DNA/RNA Molecule: Synthetic oligonucleotide
  Description of Artificial Sequence: Synthetic oligonucleotide
ggaggauucuaguuaguuutt

SEQ ID NO: 2384 - RNA, 19 nt, Homo sapiens
accaaggccagcacauagg

SEQ ID NO: 2385 - RNA, 19 nt, Homo sapiens
ccaaggccagcacauagga

SEQ ID NO: 2386 - RNA, 19 nt, Homo sapiens
caaggccagcacauaggag

SEQ ID NO: 2387 - RNA, 19 nt, Homo sapiens
aaggccagcacauaggaga

SEQ ID NO: 2388 - RNA, 19 nt, Homo sapiens
aggccagcacauaggagag

SEQ ID NO: 2389 - RNA, 19 nt, Homo sapiens
ggccagcacauaggagaga

SEQ ID NO: 2390 - RNA, 19 nt, Homo sapiens
gccagcacauaggagagau

SEQ ID NO: 2391 - RNA, 19 nt, Homo sapiens
ccagcacauaggagagaug

SEQ ID NO: 2392 - RNA, 19 nt, Homo sapiens
cagcacauaggagagauga

SEQ ID NO: 2393 - RNA, 19 nt, Homo sapiens
agcacauaggagagaugag

SEQ ID NO: 2394 - RNA, 19 nt, Homo sapiens
cacauaggagagaugagcu

SEQ ID NO: 2395 - RNA, 19 nt, Homo sapiens
acauaggagagaugagcuu

SEQ ID NO: 2396 - RNA, 19 nt, Homo sapiens
cauaggagagaugagcuuc

SEQ ID NO: 2397 - RNA, 19 nt, Homo sapiens
auaggagagaugagcuucc

SEQ ID NO: 2398 - RNA, 19 nt, Homo sapiens
uaggagagaugagcuuccu

SEQ ID NO: 2399 - RNA, 19 nt, Homo sapiens
aggagagaugagcuuccua

SEQ ID NO: 2400 - RNA, 19 nt, Homo sapiens
ggagagaugagcuuccuac

SEQ ID NO: 2401 - RNA, 19 nt, Homo sapiens
gagagaugagcuuccuaca

SEQ ID NO: 2402 - RNA, 19 nt, Homo sapiens
agagaugagcuuccuacag

SEQ ID NO: 2403 - RNA, 19 nt, Homo sapiens
gagaugagcuuccuacagc

SEQ ID NO: 2404 - RNA, 21 nt, Artificial Sequence
  Description of Artificial Sequence: Synthetic oligonucleotide
accaaggccagcacauaggag

SEQ ID NO: 2405 - RNA, 21 nt, Artificial Sequence
  Description of Artificial Sequence: Synthetic oligonucleotide
ccaaggccagcacauaggaga

SEQ ID NO: 2406 - RNA, 21 nt, Artificial Sequence
  Description of Artificial Sequence: Synthetic oligonucleotide
caaggccagcacauaggagag

SEQ ID NO: 2407 - RNA, 21 nt, Artificial Sequence
  Description of Artificial Sequence: Synthetic oligonucleotide
aaggccagcacauaggagaga

SEQ ID NO: 2408 - RNA, 21 nt, Artificial Sequence
  Description of Artificial Sequence: Synthetic oligonucleotide
aggccagcacauaggagagau

SEQ ID NO: 2409 - RNA, 21 nt, Artificial Sequence
  Description of Artificial Sequence: Synthetic oligonucleotide
ggccagcacauaggagagaug

SEQ ID NO: 2410 - RNA, 21 nt, Artificial Sequence
  Description of Artificial Sequence: Synthetic oligonucleotide
gccagcacauaggagagauga

SEQ ID NO: 2411 - RNA, 21 nt, Artificial Sequence
  Description of Artificial Sequence: Synthetic oligonucleotide
ccagcacauaggagagaugag

SEQ ID NO: 2412 - RNA, 21 nt, Artificial Sequence
  Description of Artificial Sequence: Synthetic oligonucleotide
cagcacauaggagagaugagc

SEQ ID NO: 2413 - RNA, 21 nt, Artificial Sequence
  Description of Artificial Sequence: Synthetic oligonucleotide
agcacauaggagagaugagcu

SEQ ID NO: 2414 - RNA, 21 nt, Artificial Sequence
  Description of Artificial Sequence: Synthetic oligonucleotide
cacauaggagagaugagcuuc

SEQ ID NO: 2415 - RNA, 21 nt, Artificial Sequence
  Description of Artificial Sequence: Synthetic oligonucleotide
acauaggagagaugagcuucc

SEQ ID NO: 2416 - RNA, 21 nt, Artificial Sequence
  Description of Artificial Sequence: Synthetic oligonucleotide
cauaggagagaugagcuuccu

SEQ ID NO: 2417 - RNA, 21 nt, Artificial Sequence
  Description of Artificial Sequence: Synthetic oligonucleotide
auaggagagaugagcuuccua

SEQ ID NO: 2418 - RNA, 21 nt, Artificial Sequence
  Description of Artificial Sequence: Synthetic oligonucleotide
uaggagagaugagcuuccuac

SEQ ID NO: 2419 - RNA, 21 nt, Artificial Sequence
  Description of Artificial Sequence: Synthetic oligonucleotide
aggagagaugagcuuccuaca

SEQ ID NO: 2420 - RNA, 21 nt, Artificial Sequence
  Description of Artificial Sequence: Synthetic oligonucleotide
ggagagaugagcuuccuacag

SEQ ID NO: 2421 - RNA, 21 nt, Artificial Sequence
  Description of Artificial Sequence: Synthetic oligonucleotide
gagagaugagcuuccuacagc

SEQ ID NO: 2422 - RNA, 21 nt, Artificial Sequence
  Description of Artificial Sequence: Synthetic oligonucleotide
agagaugagcuuccuacagca

SEQ ID NO: 2423 - RNA, 21 nt, Artificial Sequence
  Description of Artificial Sequence: Synthetic oligonucleotide
gagaugagcuuccuacagcac

SEQ ID NO: 2424 - RNA, 23 nt, Artificial Sequence
  Description of Artificial Sequence: Synthetic oligonucleotide
cuccuaugugcuggccuugguga

SEQ ID NO: 2425 - RNA, 23 nt, Artificial Sequence
  Description of Artificial Sequence: Synthetic oligonucleotide
ucuccuaugugcuggccuuggug

SEQ ID NO: 2426 - RNA, 23 nt, Artificial Sequence
  Description of Artificial Sequence: Synthetic oligonucleotide
cucuccuaugugcuggccuuggu

SEQ ID NO: 2427 - RNA, 23 nt, Artificial Sequence
  Description of Artificial Sequence: Synthetic oligonucleotide
ucucuccuaugugcuggccuugg

SEQ ID NO: 2428 - RNA, 23 nt, Artificial Sequence
  Description of Artificial Sequence: Synthetic oligonucleotide
aucucuccuaugugcuggccuug

SEQ ID NO: 2429 - RNA, 23 nt, Artificial Sequence
  Description of Artificial Sequence: Synthetic oligonucleotide
caucucuccuaugugcuggccuu

SEQ ID NO: 2430 - RNA, 23 nt, Artificial Sequence
  Description of Artificial Sequence: Synthetic oligonucleotide
ucaucucuccuaugugcuggccu

SEQ ID NO: 2431 - RNA, 23 nt, Artificial Sequence
  Description of Artificial Sequence: Synthetic oligonucleotide
cucaucucuccuaugugcuggcc

SEQ ID NO: 2432 - RNA, 23 nt, Artificial Sequence
  Description of Artificial Sequence: Synthetic oligonucleotide
gcucaucucuccuaugugcuggc

SEQ ID NO: 2433 - RNA, 23 nt, Artificial Sequence
  Description of Artificial Sequence: Synthetic oligonucleotide
agcucaucucuccuaugugcugg

SEQ ID NO: 2434 - RNA, 23 nt, Artificial Sequence
  Description of Artificial Sequence: Synthetic oligonucleotide
gaagcucaucucuccuaugugcu

SEQ ID NO: 2435 - RNA, 23 nt, Artificial Sequence
  Description of Artificial Sequence: Synthetic oligonucleotide
ggaagcucaucucuccuaugugc

SEQ ID NO: 2436 - RNA, 23 nt, Artificial Sequence
  Description of Artificial Sequence: Synthetic oligonucleotide
aggaagcucaucucuccuaugug

SEQ ID NO: 2437 - RNA, 23 nt, Artificial Sequence
  Description of Artificial Sequence: Synthetic oligonucleotide
uaggaagcucaucucuccuaugu

SEQ ID NO: 2438 - RNA, 23 nt, Artificial Sequence
  Description of Artificial Sequence: Synthetic oligonucleotide
guaggaagcucaucucuccuaug

SEQ ID NO: 2439 - RNA, 23 nt, Artificial Sequence
  Description of Artificial Sequence: Synthetic oligonucleotide
uguaggaagcucaucucuccuau

SEQ ID NO: 2440 - RNA, 23 nt, Artificial Sequence
  Description of Artificial Sequence: Synthetic oligonucleotide
cuguaggaagcucaucucuccua

SEQ ID NO: 2441 - RNA, 23 nt, Artificial Sequence
  Description of Artificial Sequence: Synthetic oligonucleotide
gcuguaggaagcucaucucuccu

SEQ ID NO: 2442 - RNA, 23 nt, Artificial Sequence
  Description of Artificial Sequence: Synthetic oligonucleotide
ugcuguaggaagcucaucucucc

SEQ ID NO: 2443 - RNA, 23 nt, Artificial Sequence
  Description of Artificial Sequence: Synthetic oligonucleotide
gugcuguaggaagcucaucucuc

We claim:

1. A composition comprising a first double-stranded ribonucleic acid (dsRNA) for inhibiting the expression of a human kinesin family member 11 (Eg5/KSP) gene in a cell and a second dsRNA for inhibiting expression of a human VEGF in a cell, wherein:
   both said first and said second dsRNA are formulated in a stable nucleic acid lipid particle (SNALP) wherein said SNALP comprises DLinDMA, cholesterol, DPPC, and PEG2000-C-DMA;
   said first dsRNA consists of a first sense strand and a first antisense strand, and said first sense strand comprises a first sequence and said first antisense strand comprises a second sequence complementary to at least 15 contiguous nucleotides of SEQ ID NO:1311 (5'-UCGAGAAU-CUAAACUAACU-3'), wherein said first sequence is complementary to said second sequence and wherein said first dsRNA is between 15 and 30 base pairs in length; and
   said second dsRNA consists of a second sense strand and a second antisense strand, said second sense strand comprising a third sequence and said second antisense strand comprising a fourth sequence complementary to at least 15 contiguous nucleotides of SEQ ID NO:1538 (5'-GCACAUAGGAGAGAUGAGCUU-3'), wherein said third sequence is complementary to said fourth sequence and wherein each strand is between 15 and 30 base pairs in length.

2. The composition of claim 1, wherein the first antisense strand comprises a second sequence complementary to SEQ ID NO:1311 (5'-UCGAGAAUCUAAACUAACU-3') and the second antisense strand comprises a fourth sequence complementary to SEQ ID NO:1538 (5'-GCACAUAG-GAGAUGAGCUU-3').

3. The composition of claim 1, wherein the first dsRNA consists of a sense strand consisting of SEQ ID NO:1534 (5'-UCGAGAAUCUAAACUAACUTT-3') and an antisense strand consisting of SEQ ID NO:1535 (5'-AGUUAGUUUA-GAUUCUCGATT-3') and the second dsRNA consists of a sense strand consisting of SEQ ID NO:1536 (5'-GCA-CAUAGGAGAGAUGAGCUU-3'), and an antisense strand consisting of SEQ ID NO:1537 (5'-AAGCUCAUCUCUC-CUAUGUGCUG-3').

4. The composition of claim 3, wherein each strand is modified as follows to include a 2'-O-methyl ribonucleotide as indicated by a lower case letter "c" or "u" and a phosphorothioate as indicated by a lower case letter "s":
   the first dsRNA consists of a sense strand consisting of
   SEQ ID NO:1240 (5'-ucGAGAAucuAAAcuAAcuTsT-3')
   and an antisense strand consisting of
   SEQ ID NO:1241 (5'-AGUuAGUUuAGAUUCUC-GATsT);
   the second dsRNA consists of a sense strand consisting of
   SEQ ID NO:1242 (5'-GcAcAuAGGAGAGAuGAG-CUsU-3')
   and an antisense strand consisting of
   SEQ ID NO:1243 (5'-AAGCUcAUCUCUCCuAuGuG-CusG-3').

5. The composition of claim 1, 2, or 3, wherein said first and second dsRNA comprises at least one modified nucleotide.

6. The composition of claim 5, wherein said modified nucleotide is chosen from the group of: a 2'-O-methyl modified nucleotide, a nucleotide comprising a 5'-phosphorothioate group, and a terminal nucleotide linked to a cholesteryl derivative or dodecanoic acid bisdecylamide group.

7. The composition of claim 5, wherein said modified nucleotide is chosen from the group of: a 2'-deoxy-2'-fluoro modified nucleotide, a 2'-deoxy-modified nucleotide, a locked nucleotide, an abasic nucleotide, 2'-amino-modified nucleotide, 2'-alkyl-modified nucleotide, morpholino nucleotide, a phosphoramidate, and a non-natural base comprising nucleotide.

8. The composition of claim 1, 2, or 3, wherein said first and second dsRNA each comprise at least one 2'-O-methyl modified ribonucleotide and at least one nucleotide comprising a 5'-phosphorothioate group.

9. The composition of claim 1 or 2, wherein each strand of each dsRNA is 19-23 bases in length.

10. The composition of claim 1 or 2, wherein each strand of each dsRNA is 21-23 bases in length.

11. The composition of claim 1 or 2, wherein each strand of the first dsRNA is 21 bases in length and the sense strand of the second dsRNA is 21 bases in length and the antisense strand of the second dsRNA is 23 bases in length.

12. The composition of claim 1, 2, 3, or 4, wherein the first and second dsRNA are present in an equimolar ratio.

13. The composition of claim 1, 2, 3, or 4, comprising the components in the proportions listed in Table 17.

14. The composition of claim 1, 2, 3, or 4, wherein said composition, upon contact with a cell expressing Eg5, inhibits expression of Eg5 by at least 40, 50, 60, 70, 80, or by at least 90%.

15. The composition of claim 1, 2, 3, or 4, wherein said composition, upon contact with a cell expressing VEGF, inhibits expression of VEGF by at least 40, 50, 60, 70, 80, or by at least 90%.

16. The composition of claim 1, 2, 3, or 4, wherein administration of said composition to a cell decreases expression of both Eg5 and VEGF in said cell.

17. The composition of claim 16, wherein the composition is administered in a nM concentration.

18. The composition of claim 1, 2, 3, or 4, wherein administration of said composition to a cell increases mono-aster formation in the cell.

19. The composition of claim 1, 2, 3, or 4, wherein administration of said composition to a mammal results in at least one effect selected from the group consisting of prevention of tumor growth, reduction in tumor growth, or prolonged survival in said mammal.

20. The composition of claim 19, wherein said effect is measured using at least one assay selected from the group consisting of determination of body weight, determination of organ weight, visual inspection, mRNA analysis, serum AFP analysis and survival monitoring.

21. The composition of claim 1, 2, 3, or 4, further comprising Sorafenib.

22. The composition of claim 1 or 2, wherein the first dsRNA contains two overhangs and the second dsRNA contains an overhang at the 3' of the antisense and a blunt end at the 5' end of the antisense strand.

23. A method for inhibiting the expression of Eg5/KSP and VEGF in a cell comprising administering any of the compositions of claim 1, 2, 3, or 4 to the cell.

24. A method for preventing tumor growth, reducing tumor growth, or prolonging survival in a mammal in need of treatment for cancer comprising administering the composition of claim 1, 2, 3, or 4 to said mammal.

25. The method of claim 24, wherein said mammal has liver cancer.

26. The method of claim 24, wherein said mammal is a human with liver cancer.

27. The method of claim 23, further comprising administering Sorafenib.

\* \* \* \* \*